United States Patent 12,642,819 (COMPOSITIONS AND METHODS FOR TREATING INFLAMMATORY BOWEL DISEASE) - sequence listing, part 6

SEQ ID NO: 4 - DNA, 5647497 bp, Bacteroides dorei (residues 1-1,882,499 of 5,647,497)
  modified_base (463663)..(463672): a, c, t, g, unknown or other
  modified_base (704262)..(704358): a, c, t, g, unknown or other
  modified_base (2019734)..(2019829): a, c, t, g, unknown or other
  modified_base (3060158)..(3060255): a, c, t, g, unknown or other
  modified_base (5495356)..(5495476): a, c, t, g, unknown or other
  modified_base (5497126)..(5497610): a, c, t, g, unknown or other
  modified_base (5499044)..(5499722): a, c, t, g, unknown or other
  modified_base (5546024)..(5546186): a, c, t, g, unknown or other
  modified_base (5548181)..(5548381): a, c, t, g, unknown or other
  modified_base (5586635)..(5587382): a, c, t, g, unknown or other
  modified_base (5599887)..(5600005): a, c, t, g, unknown or other
atttatacgctatagcggtgacaaaacactatgccggatttctagaaattaatttatcggcaggaataaaactagtgccaccactcatggagccggctttacaaatattgaagccggcttcataaaacaagttctttactttcctgtagtctgtggtgaaataaatttatcttctaggcttaatatccaattttaccggtttcaacatgttctccggacttagaattgtatccaactcttccttatttaaaataccatgttccaagaccagttcatagacacttctacctgtttccaacgcttcttttgcaatctttgtagaatttttataaccaataatcggattcaatgcggttactacaccaatactgttatgcacttcaatcttgcagcgttccgcattagcagtaataccttctacacaacgtgtacgcagggtttcaaaaccattgaccattaaatctacagattcaaaacaacactgtgccatcaccggttccatagcattcagttccatttgagcagcttcgccagccatagtcacgcatagttcgttacctattactttataacaaatctgattcatcacttcaggaatcaccggattcaccttacctggcattatagaagatcccggttgcatagccggaaggttgaattctcctaaaccacaacgcggtccactggccagcaaacgtaaatcattacatattttatttacttttacggctaccctttttaaagctgaagcataacctaccaagcaggaagtatctgaagtagctcctaccaaatctgacgacaatttgaaatcaaaacctgtaatttcacacaatgcttccacacatttttctgcatatcccggttccgcacaaatgcctgtaccaatagcggtagcacccatatttactgtcaggaagtctgccgccgcttcattcaaatgacgaatttcgtctctcaatatactggcaaaaccattgaatgtctgacctaaagtcataggtacggcatcttccaactgagtacgccccattttgatgatatgtgcaaactcttctcctttcttatggaatgcaccaatcagcgattccaaataaggaagaaaacgaagatgagaataatacataccaatatggattgcagtgggataagcatcattcgttgattgtgagcagttcacatggtcattaggagagcaatattgatactcgccacgtttgtgtcccataatctccaaagcacggttagcaatgacttcattagcattcatattggtagaagtaccggcacctccctgaatcatatccaccgggaattgctcatgatgctcaccatttaagatttcctgacacgccaatactatggcatctttttgttctttagttaataaacctaactcatagttagccattgcagctgccattttcgtaatggcaagaccgttaataaacaacggatattcatttagatgaaatttactaattgggaaattttctatgcctcttagagtttgcacaccatacaatgcactggccggaatttcgcgggcaccaattaaatcactttctactcgggtttcttctgtaagttttgtttccatgatcaggttatttattagtttatcatttcttattttatatagcaaaggtataaactaacattttgatatcaaaatataatctgatataattttaaaatattattttatacatgtttattgctgcaaaacagacaacaaacttacattatgaaagtttactcagttaacaaagtcttatatcatttgaagttcattcaaaaaacagacataaaaaaaggcgtccattcagaacgcccttattctattttttaacttcggaactcttatttcacctttattctatcaaagccttctccaaatacaccaatgacagcactttgtgatacaaatgcgttcggatcgatatcttttatcaaacggaatatagtagtagactcacgtttttttgcaagcacaaacatcattttcacacccgcaccggtataacaacctactccgtcaatgaacgtcacccctcgatgaagatctttatttatgcgatgccctatttcttcatgcttcttcgaaatgataaagaattgcactgactgacgagcactatttaccacctgatccaagacaaagctggatataaacaagacaacatatccatataccaccttctcccaatcatgcaatacaaaataactggaagagataataaccaaatcacacatcaaaataacccggcccaaagtaatatcacgatacttattgacaatagcagctataatatccgtacctcctgtgctaccattggcagaaaaagcgacaccaataccacctccgcagaaaaaggctcccaagacacaagccatgaaaggttgatcatgtattaaagactctccccctgtcaaatcctgtatgataggcaaaatagaagtcagcacaaatacagcatagatggttttcacactaaacttccatcccaaaataaccaaagaaagtatcaacaatactccgtttattcccaaataggtgtactggaccggcaaaccggtagcccaataaacaatagaagcaatacctggcaccgcacctgaaggaaggtcattaggtaacaaaaagacggtccatccgatagcatacatcagcataccaagagcaatcaacatataatcccttagttctctgataacccgttgcttacgcgtcgtaataaagactgaatccatgtgagttttcctttataaaatcatattgtccgcaaaagtacaaaaagattgaatcacttggcttcaaaaggtgacattttttcaagtaaaaagtcctgttaatctgatttatcaaaaacaacagtacttttcaccctttattattctttggggtgtaaataccaatctttataatccgcaccaaaagaatctctccactgtttaaactcgggataataggtggtaatagacaccttctctgaaggccatctaaattcactgttactgatatttatagcgaaaggcatattatcttctgctatataatacattggggaaccattggaatcttgactcaaatcactacccgtaccacgtaaactctcatcagctacgcttgtcggcttatagcctgacaaatgtacttcatgagaacgtttattcacaaaaatgaaagaattgtaaggcggataagcatccatatcgcttactttatcatattttttaaatccgatcactacagtcacaggctttttgagaacaggctttatatcagaaaaaagtattaatacaggcttttctattcccggctcaaagttttttccgatcacattaccttcttgactcacctgcaccaaatcgatatgctccttccctacgtaatccaactggaaaccaaacccatttgtataagtagcaccatcattcatcggagtaaaagtagtagtggtgcgcaccaatgcgttagaagatttatctttcacaactgtactggaataatatatcacaacatcattcatatcataatcattcttatcaggccaattgtcctcataagccaaagaccctttgactacatacgaaatttcacccttatttacttcatccggtatattaggagtaggttctacagaagaagaagcagatgccataatagcaaactgtacatcattaaaacgcatgtccacattatcttccatagccataaagaaacaattgtccagttccggatcacttaacaaaactgaacgttgctctttattatcgttatatgcaggattagaataacgaggaaaaacacccttttcttttccaaatcccattcccaataaaatccatccaatatgagtgccttgggggaattcatcttcatacttgctttgttccttattccaatattttagttttatttgctcaccgactaaagatttaggagcattcctactggaacgaggaatcaggatggtcttttttatggtagccatgtccacggactctccttctttataagtataataagcaaccatatcctcccacgtagtagacgagaaattaaaataagtcgctaccaaacctgtagatttagttattaccatatcattactccctgaagtacgcagttccggaaatctttccaacaaattacgattatctactactatagaacggcttaaattactgcatctctctaaaaaagcaccaggtatatccaacttttcaggcaacaaataatcaggaaccccattttcattccaattacccaatacatcatatccgtcaggataactcactcctcccattactgctctagaacgcccatcggcagacagttgtgccttataatcaacataattaaaggttagtccgtcagatagtaattccaattcaacaggtgatacgaccaacacattatcagttaccagccatacctttttcaaataagccggcaaagatacttttgaaaaaaatctaccattcatatcagtcgaagcagcataaatgggatttatatctttaaactcccaagtattttcaactaattccataggatattcatcatacagataaaaagcagtctgtactttcataccataatcaataataagttgactattacggacagtagtaaaatcaaaaaaatcgtctttattgattttttcctccccttcttcccctccccccgtgtatatatcatgcatattacgcaagcaagacacaaagaaaactgataagcagatgatccaaaattttgttttcataaagtagtgcgtgattattttcggcaaatatagccataaataactaaaaaacaactaaatagtcaaaaaaaactgtcccccgactcacgtcggagaacagccacaacacaaacacaaaataaaacacgacaaaactactatgcaattttttagcctgctctatgttttgagtaacataactaccgccaatcaggtattcacatatccaagaggggtttcaggttatttgcatctataaaacgccacactagcgtcctttgttcatcggtctttctaaaaatatcttaatttttattgaattcctctttctcttagcttcaactgccagttccaagccgaacgtagcgtgtcctccaaattggcttctgccttccatcccaactccttattagcgaagtcaggattagcccataccttctcaatatctccggcacgacgacccacgatctgataattaagtttcacaccggtagctttttcaaatgtattgatcagttccaatacagaaacgcctttacccgttccaatattaaagacttccaccttctccttctgcttgttattcaaaatgcgatccattgcgataacgtgagccttcgccaaatccactacatatatatagtcacggatgcaaaaaccgtccggtgtatcataatcatccccaaacacactcagtttttcacgaatacccattgctgtctgagtaacgtagggtaacaagttttgtggaacaccattaggtaattcacctattaatgcagtgggatgtgcgccaataggattaaagtaacgcaacataatagcattaataggcgatcccgaagcaactgtatcacgaataatttcttcattgatctgttttgtattaccatacggagactcagccttcttaatcggagcctcttccgttacaggaagaacatcgggctgaccatacaccgtacatgatgatgaaaaaataataccttctactccatgtttcggcattaactccaacaggttaatcaatgaaaccaagttattgcgataatacaacaacggtttttgtaccgattcacccacagccttgctagccgcaaaatgaataataccttttatgcccggatatttagtaaacagcttgtccattccctcaaaatccaagcaatccaacttttcaaatgcaggacggattcctgaaaccttttctatattatctaccacatcggcgcttgaattggacaaattgtccacaatcactacgtcgtaaccgctattttgcagctctactaccgtatgagaaccgatgtagccggttcctcctgttactaaaattctttctttcataatacttaatattctgtcgttttctaataggttcaaaacaacttcgacgggtaaatcccttttcgtatcatatcattgatacgaagcaggacttgtatcttgtcatcatgcgataccaaccccatccatctggcaggtgtctcaatcactttcaccctgactccgtcagcaatacgctcattcataaaagccggaatagaataatgagctttcatatccattccattctcatctataaacttatcgaacgccttcttcatctcaccaaatacctgcggagtaaatccccacatattcattgaaaccaagctgttgtcatccaaagctacccatttatgtaattcattaggatacatcggatttccacttatccgttctactcctacacggtctgtaacggacaacagatatcccttttcatccacttcacaaataccacgggtaacccctccgctttccgccaatacatttctcagcctgtagcaaatattgaaactatggtagtcagcttctcccaacatcaccagattatcatataacaattcaaaactttctctttggtaaaagttcacggcatttatcacaccgaatggagagtcaatcaactcttctcccatcaaaacagctcttaccgagccgtacagtgctttgcgtttcggattacgcttttcttcaggaatcgtttccacatcctgataaacatactccacttctaccacatgttcatatttgcctgataccagtttcttgaattcttgttcaaaatgtctgcttatgacaaatacgatcttatcaaatccgactcttacggcatcatatatggaaaaatctaatattgtttcgccattaggacctattccctccagctgtttcaatccaccatatttattccccatagtggccgcgagtacaatcaaggtcatagccatttaatctctctattaattctaatgcaaaaataagcataaaaattgaatttacggacaagaacaatggatttctttctaataaaaaagtccgaagctgtgctccggacttctgaatcggtttattttaacgatgaagtgaactattctattccaaacagaacacccaaacctttgtctacacctgaaaatcccatgaatgccattgccagcagaccggcagtaaccaatgcgatagccattccctgcattcctttaggtatattcaccaaacttaattgttcacggatacctgcaaacaataccatagccaaagcaaaaccaagagctgtagagaaggcgtaaaccacgccagtcaacaaatcaaaatctttctgaatgaccaagatagctacacccaaaatacagcagttagtggttatcaacggaaggaatactcctaatgcctgataaagggcaggagacactttcttcaatatgatttccaccatctgtaccaatgctgcaatgacaaggataaacgcaatggtctgcaaatattccaacccgaaagcatcgagtacaaatttctggataagataggtaacaatggtagcgatggtaagcacgaatgcaacagccgcacccatacccgtagctgtctcaacttttttggatacaccgaggaacgggcagatacccaagaattgtgacaacacaatgttgttcacaaatatagcggtgataaatatcaatatatattccatattcttactttttacgggttatgctttcttcagtttattcacaatcgcaataaggtatcccaatgcaatgaaggctcccggtgcgagaacgaaaatcaacattccgtattgctcaggcatgatagtgatatcaaacaacttgcctgtgcctaggaactcacgtacaccaccaaggatagtcaatgcaagagtaaatccgagccccatacccagtccatcgaagaatgaaggcacgggaccgttctttgctgcaaaagcttcggcacgtcccagcagaatacagtttactacgatcaatgggatgaacaagcccaaagtagcataaagtgccggcacatatgcctgcataatcatctgcaacaaggttacgaatgatgcaataaccacaacaaaggccggaatgcgcaccatatcaggtatcaaattcttaatggccgaaattacaacattagaacagattaatacaaaagccgtagccaatcccatccccataccattgatggcagaagatgttgttcctaatgtaggacacatacccaaaaggagtacaaacgtgggattctcttttacaatcccgttcatcaatactttaaaattattcatagtctgctccttccttattttttatttttacaatcttgcttgggacattctacttttttgcagtctgccttatcgcagttagcaggatcacatttatcgctacaaacagtcttgcaggctgtagagtcacaaacctgcttacatgcctcgtttccttcacattgagcatcgcaggcagtagcattttcggcaacagtttcagacacttgctgagttgcaccactagcgccatccacattctgaccactatatgctgcataagcattgttcacagcttttagaaaagcacgtgtagtgatggtagaagctgtgatagcatctatctgaccaccatccttatttaccaccaatgctccctgtcccggattcataccggtaatgtcgccttttgcacctttcttaaaccaatcagccgcctttgaccccaagcccggagtctcagcatggctcaacaaagaatagtctatgatatttccctctttgtcaaaacctaccagcacactcaaagcgccaccaaaaccattggcagaagattctacggcagcaccaataaattcgccacccttggttgccttatatattttataagtagcaccatccaattctatagtttcaggagcttccgcaggattgttatcaaaccccggaactacaactgcaatagcgtcactcaaagcttttgcattagcctcagcaataggaccggcagtcagttggttgacataagccaaaagtccggttgcaatcacagtaatcgctgtcagcacgataaccatgtttttcaaagatgattctagttttttcatttcttcacgacctccccgaatcttttaggtttacaataagtattgattaacggagtaaatgcgttcataatgaatatagcgaaagacataccttcgggatatgcaccgaacaaacggataaccacggtcaggaaaccgatagccacaccgtatataatcatacctttatgagtcataggcgaagtaacatagtcggttgccatgaaaatagcacccaacatcaaaccacctgtaaacaagtgagccaacggagatgcataagccaccggatcaaccaaatgcatcagaccggcaaatacaaatacagtcaccagaatagatacaggaatatgccaggaaataatctttttccatagcatatatcccaggccaagcaataaagccaatgcactcacctcacctagcgaacccgggttattacccagaaacagacttaatgtatcgggcaactgacctaaagcatttacatcaccctttacagccattttcatcaatgccagcggagtagcaccggtttcagcatcggtataacttccccattgttgaaccaacggccatgaagtcatctgcacaggaaaagaaatcagcaagaagatacgacctaccaacgcaggattaaaaggattacaacctaatccgccgaaagtcatcttgcccacaccgattgccaccaacgcaccgatgataataatccaaagcggcaagttggaaggcagattgaatgccagcaacacaccggttataatagccgaaccatcacagatggtagagcgttctctcttcaaaataaacttggtaatcgcccattcgaagaatacacaagcggcaaccgaggtcaaggtcaccaccacggcgcccagtccgaacatataaaatgacaccagcaacgcaggtatcaacgcaatgagtacaccatacatattcttctgtatgctgtcaccgctatgaacgtgaggcgataatgatactattaatttattagccatactattttgtcgaattattttttagcattacgtgcacggataataccgcctactgtgcccttacccaaacggatatagtccagcaaataacgatgagacggacatgtaaactgacacgaaccgcactcgatgcacgacattacatcttctttctctactctctcccaatccttatgagctgaaagtgttgccaataagaaaggctccagtcccatgggacacacgttaacacacttggcacagcggatacagggctgagcttccgcacgggcagcttccttatcattcataatcagcacacccgaactacctttacaaataggaacttctgtattaaccagtgctttacccatcatcggaccaccaccaatcacttttcccgtatcttcgggcaaaccgccagccgcatcaatcagctggctcatcggagtccccatacgagtgagaaaattagatggatttctgacagacttacctgtaacggttacaatgcgttcaaacaaaggtttgtttttctgaacggcctcataaacggcaaatgcagtacctacattctgaactaccgcacccacattgataggaatagcgggaggagcaggaacctggcgaccgatcacagcatctatcaactgtttctcaccaccttgcggatatttcacctgcaaaggaaccacctctataccgggatactgagcagccttttcagtcatcaacttaatagcatccggtttattattttcaataccgatatatcccttggtcacttttgcagctttcatcaggatgcttacacccaccagtacttcgtctgccttttccaacatcaaacgatgatcggcagtgaggtaaggctcacactctacagcattgataattacacattccgccttgcagcccggaggaggagaaagtttcacatgagtagggaaacaagcaccgcccatacctactacacctgcatttttcactttagcaacgatttcttcgggtgtgagagcacactctttcaccaatgtcgaactgcggtctattgattcttcccattcgtcaccatccacatcgataaagatagccggcttgcggtaaccgcttgcatcgattacggcgtctaccttgttcactttaccggatacagacgagaagatggctgctgaaacaaagccacccgcctcagcaatcttcgtacctaccttcaccacatcgccttttttcacgatggcagtagcaggagcaccgatatgctgtgacaaaggaaataccgcttgcttaggaagtgcaagggtttcaatggctttgcctgctgacaatttattttctgctggatgtactccaccaattctaaatgtcttcactgttatatctttttaatttttacttactttgaattttgattatgcttccgctttcggagcctcagctttcaccgcttccggagtttccacctttgaagcctctacttttgcagcaggttttgcagcagcctcaccagccggcacttctaccttcggtttacgtggcgggaaattaatagcttggatagcccctttcgggcattccgattcacatttacggcaagatttacacttagccggatcaatgtatgccaaattattctctaacgtaatggcttcgaacggacacactttcacacactttccacaaccaatacaactagccttgcaagccttgttggcaacagctcccttatccttgttcacacacatcaccactacgcggcggttgttctttcctttcggacgaatttcaatgatcttacgcggacaagctttgctacaagccccacaagctgtacatttttcttcgtccacttccggaaggccggtttcaggattcatgtgaatagcatcaaactgacacacttccacacaatcaccacaacccagacaaccgaatgtacaacccgtctcaccacctgaagtggcatgagcgatggcacacgatttagctccgtcatacagagcagtacgagggcgattttcacaactaccgttacatcttaccaccgcaactttcggttcggcagcaacggcttccaatcccaaaatggcagctactttctccattaccggagcaccaccaaccggacataacttaccctccagcgaaccggcatcggcagccttcacgcaggcaccagcaaaaccagagcaaccgggataaccacatccaccgcaattcgcctgaggaagcacttcgctcaccttggcaatccgcggatcttcatacacagcaaacttcttagaagcggcatacaagattaccgcggcaatcaagccaatcgctcccaacgaaattactgcaaccagaattaaatccataaattttagttagttatttattaattattttttattggttcaagcgtaaatgaaaacttcttgctcaacttattcctgcatacatatatgataaggtaatacgggagcaaggctgacaaagcaacaagcgccgaccttaactcatccccccccgtaaaacgcatggaaataaataaagtaatcagcaataccaagaaagggataccaaaagccagcaatacggcttgcatccccatggaagtggtaccataaatcatcacctcctcacctatgcggtaagaagatgccttcatgtcaaaaacatcaatcagtttctctttactttcagatgcattgcaatgccctttcacactacaagccgaacaggcagaagtttgtacgattctcacccgcacatgagaaccttcaatgttttccacaataccacgatgtttgattatatcggtcatttttgcaaactctacattacaaaactgcggcaaatgtacgattttaattggattctaagaagtataaaatgatattttcactataaaaatcgattttttgtgtggagaaattaaaattagaaacaagaaagggaggaaaattttaaattcccccctttctacttgtaaagtatataatttatttcattatcacatagcctgcatccaagagtttttgacgaatggatgctatatgttcctcgtttctggtttccataacgacacgaagggcacatccggtgacatctgcactctcactatttcgctcatgatgtacagaaattacatttcctccctgctctgcgataattttgctgactcccaacagctgccccggtttgtctatcaagtccaaagttactgcataggtacgtcccgactttgccataccgcgactgatgacacggctcaatatcgtcacatcaatattacctccagacaccaggcaaacagttttcttaccctttaccggtaccttattgaacatggctgcagcaacggacacagctcccgccccctctgcaacaatccgctggcgttctatcaatgccagaatagctgcggcaatctcatcctcggtcacagttacaattccgtccacatactgattaaccaagtcaaaagtatttgttcccggctctttcaccgcgattccatcggcaaaagtggaaacagagtgaagacgctcaatacgcgaatgaagaatagaatttgccatactggccgcacccaacgcctgtacaccatataccttgacagacggtttcaaagccttcaacgcataagccactcccgaaatcagtccgcccccaccaatggggacaatgactacctccacatccggcatttcctccaataactccaaaccgatagtaccttgtccggctatcacattctcgtcatcaaagggatgaacaaaagtatatcccttttcatcacgtaattgcagagctttctgataagcatcatcatagactcccggaaccaaacaaacttccgccccataatgcttcgtagcctcaactttagatataggtgctccctctggaagacaaatcaacgacttgatgccacacttagtggcagccaatgccaccccttgcgcatgattaccggcagaacaggctatcacacctctcgccttttcttcatcagacaattgggaaatcttgtaataagcaccacgcactttaaacgatcctgtgaattgcaggttttcgggcttcagataaactgtactctcaggatttatctgaggagcataaatcaaatcagtgcgacggacaacctctttcaggacatgagccgccttgtatattgcatctaattgtagcataggtataacactcttgttttttaattgggtgcaaagctacaaataaaattgattccttacactcgctttcgatgtaaagttgcattcttttttttcgctcattcatttgccggtaagtttctttacattacacaccgcgataatttttttcttagggtcttatacttttttcccggtgtcttatctggatttcgatataatctgtttttcacttttactctcggccacctctaccagataaacactggcacaaataagaacaatcgccgccaactgcgtccatgagaagcgatcctgccccaaaataaaagaggtcaccgtagcaacaatcaaaattaaatatccataaatagctaccaatgtagttttcagatatttcaatccgaggggaagtagtaaataactaatagtggtagggaataccaaaacaaaaagcaagaccaacataggagtagagaaaagtgacattctcagtataggagcatcaaagccgtaaattgtattgacaataacagccatgacagccgcccctaaaaaggtatatttcaacatcgtcatatttcccaccccttttaacagacgattgctgagaacaagatagacggcataaaccagcgaactgaccaaacacattaaattacctaacggagcattagaggcaagatcgtcactaggctgtgtagaaatgcaaagaatagctcctcccaaccccattccaataccaaacactttcatccaagttactttttccttataaaacaatacagcaataatgaatacccatataggctccaaactgacaaaaatggaactggaaaccggagtggtcttactgatacccagcagataaaaaaacatatatccgtaaatacctaaagcccctaacataaaaagctgccatttctgacgaatagtggagttttcgggtttgcaaaatatatcaataagccaaaaagcggcggccccaaataccaatcggaaagtaacccctgtcacaggagctatccacaaaggtaaaagatatttcaacgcgttcatattaaagcctcccaacgctttggagacaaccatgctaaggtttgcttcaacttgtttattcatacttcatgctgttattacgtgggtatttttcttataaactcaacttttcttgcttcatcaccacaaacatggccatcagcgccaccatcaaattgagccagaaagcaaaagtctgcgagtcagaatgaaacaagctctgtactgcatctacaataaaaggacaaagcaggatagccacataattcatagccatcacaaaggcaagtgccaatgtcaccttatgaggtacggccacatcagaggtcttatcataaatcaacggctggatgataccgtatgaaagaccgttcaggacacaccccaaagcaatcaatatctcagaacggctgagcaaaataattcccatcccacaagctatcatcaacaaacaaaccatatagatacgacgccccaacacttgcactatcctgttcagcacaaagcccggcgccatgatagcaaggaaaaacaaggaaatcaatattcctgccctgccactggaaagcccgtactcttccatcagaaaaggaaggttgaaactgataatgattaccagataagtagccagaccgtaaaaagccatcagcttgattaaggccttgacattcattcccctcttgcccatttctttggcggtatcagacggaatatcatcagacggatgataactggagaggtctttcttcagataatgagtaagaaaaatggatataaaaggaaacagataaaccaaaaacggcaaatgccagttcacttccgccagatagccagtcaatgtggtggccagtaccaaggtgatattggttatggcagaactgtaaccgaactgtttcgtacggtaagctcccacaaaataacgggatatcaatccggtggaaagcggaacaatcaacccggaccctatccccaacatggcgctgatggctatcagttgccacatcttattggagagcagataaaggataccactcaccccaaagatggccaggccgatttgcagcagcaagaggttgttcactttctctgtcagcttacccgacaacaagataaaaggaataataagaagtgacggcaacgaggacagcatctggatttccaagtctgtagcagacggaaagattttattcaaatcgcccaaaatgggagaaaccgccaatcccggcaatgcatttaatgccgaaatggaaaatatacctattaaagtaatgaggggaatagtcccctgccctgtctgtactttcatacttgtagtaatttattgtatgagatacacaacaaggcaaaagacgtttggttcaaagcgacatatcgtttattcctttactttccattccaaaatattatgccgggtagtgtcaaagtttacgcctatgttaatttcctaaacgcagtttatcaaattacatacccctaaaatatcggatacgggcatccaatgattttatgtataaacaaaggtatctctttttcgttcatagtacaatgattcccatcgtttttttgtattccccctacttacattaaaaaacataaaatcaaggaacttttcaccaacccctatgttgagggagaaaaacgcgggaaactcccacgttcttcattgtattactaacctaaactttaagtaaaaatgaaagattgtaattgtgatttgagagacggtgacgccaaaacagccgtgtttggttcaaacgaaatgctgcaacctgctccggtagacaccattcccatggaacctaccactccgcagattgcttatcaaatggttaaagacgaaacattcgcccaaacccagcctcgtcttaatctggctactttcgttaccacctatatggacgattatgctaccaaattgatgaacgaagctatcaacatcaactatattgatgaaacagagtacccgcgtatcgccgtgatgaatgccaaatgtatcaacatcatggccaacctatggaattcccccgaacaggcaaaatggaaatcaggagcgttggccatcggctccagcgaggcttgtatgctgggtggtgtagctgcctggttgcgctggagagacagacgtaaagcccagggcaaaccgaccgacaaacctaacttcgtcatttcaagcggtttccaggttgtatgggagaaattcgcccaactttggcagattgagatgcgccaagtacctcttactctggacaagcccaccctggaccccgaagaagccttaaagatgtgtgacgagaacaccatctgtattgttcctatccaaggtgtgacatggacaggtctgaacgatgacgtggaagcattggacaaagcgctggatgcctacaacgccaaaaccggctatgatattcctatccacgtagatgccgcaaccggtggcttcatcctgccgttcctcagccccgaaacgaaatgggacttccgtttgaaatgggttctttccatcagcacttccggccacaagttcggactggtttatccgggactgggatgggtagtatggaaagacaagaaataccttccggatgccatgtcattcagtgtcaattatctgggtgcgaacatcacacaggttggtttgaacttcagccgccccgccgcacagattctaggccaatactatcagtttatccgtctgggattccaaggatacaaagccatccaatacaattccatggaaatcaccaagtacattcacagcgaaatagccaagatgactccgttcgtaaactacagcgacaaagtggtaaatcctttgttcatctggtacatgaaacccgaatacgcaaagaacgccaaatggactctgtacgatttgcaggctaaattacaacaaagcggatggatggttcctgcctacaccttgccggagaacattcaaaattatgtggttatgcgtgttgtggtacgtcagggattcagccgtgacatggcggatatgttgttgaacgacatcaagaatgccatcagcgagttcgagaaactagaatatcccactcctacccgcatcgcccaagacaagaatatcgctgtaaaaggtactgtgtttactcacaatgcccatagcaacgccgctaaaaaataagcataaataacaataatgcaaccatccgccgttaaggtggatggttacttcaatcaaattaatttatggaaagaactataactatccagcaaataaaggatgctgcacaagaggcctacaatctgtataaagacaatacagacggtaagaacgccgactacattccttatctggcaaatattgatcccaaactgttcggaatcagtatctgtctgatgaacggagaaatcatccaactgggtgactctcagtaccgtttcggtatcgagtccgtttccaaggtgctgaccgctatcctggtactccgccaatacggcgcccccaaggtgctcgaaatgattggcgccgacgctaccggactgccgttcaactccatcatggctatcctgttggaaaacgaccacccttccaccccactggtaaacgccggggccatctcggcagacagcatggtacaacccctaggcaacagcgacggcaaatggaaagccatcgtagacaatatgaccgaactatgcggaagtgccccgcaactgattgacgaattgtacaaatcggagtctgcaacaaatttcaacaatcgttccatcgcctggttattgaaaaattataaccgtatctacgatgatcctgatatgtcgcttgacctatacacccgtcagtgctctatgggcatcaccgcggaacaattgtccatctgcggagccaccatcgccaacgaaggattgaacccgaatacaaacaaacaagtgttcgacaaggccctcgccccgaaaatcacctccatgatagctaccgtaggtttctaccagcacacaggcgactggctttatacctcaggaatccctgccaagaccggcgtaggaggcggtgtgatgggtgtgatgccgggtgtaatgggtatttcggccttcgcgcctcctttggacgatgccggcaactccgtaaaagcgcagcttgccatcaaatatattatgaacaaactgggcatgaacgtattcaacgggcaccgcatccacgtgcaataatatattctattctgacagaaagccgatatttctctcaccccgagagaagtaccggctttttaactaaaaattttttccgctaaatatttctcacactcttacattatgcctatctttgcacagacaaattcatatattatgaagaacaaagtcatccgtaaagaactgggccaatggatgaactcatgcagagaaaccatttatggtcccctagcggagagattgaaagaaaattgctgaaacagcccaaagcgcccgatgacgttagttatgtgattgaattaactattaaataactttatgagtaacaaatcaaaaatcgagatttgcgccaactccgtggaaagtgctgtgaaggcacaacaagccggtgcttatcgtgtagaactatgtgcaggtattccggaaggcggaacaaccccgtcttttggcgaaatccgtatggcacgccaattattgaaccaaacaaaactacatgtcattatccgtccccgtggcggagatttcctatattctcccatcgagcaagaaatcatgttgcatgatattaaagtggcacgtcagttgggtgcggacggtgtggtgttcggatgtcttaccgcagaaggcaatgtcgatgtacccttgatgcagaaactgatgaatgcggtaggcgagatgagtgtcaccttccaccgcgcttttgatatgtgcagcaatcccaaggaggccttggaacagattatcggcctgggtatcgaccgggtccttacttccggacaagaagcgaccgccgaaaagggtatccctcttttaaaagaattggtagaactggccgacggacgaatcatcatcatgccgggatgcggtgtgaatgccggtaatatccgtaagattgccgaagaaaccggaacttcggaatttcatttctccggacggagcagcgtagacagcggcatgatttatcgtaactcaaaagtatctatgggaggtactgtaaagatagaagagtatctgaaggatgttactgaccccaacaaagtaaaagccgccttgtccgaactggcattgaaagacgaaaacgacaaagcactggaaaagaaaaacaaaagcctcaaccccaagaaatcaaagaaagaggatgactgggacgatgacgatgatgatttggatgatgacaagtaataagcaagcataaacgttattatcatattaaacgcggatattcagggtttcaagctgaatatccgcgttactttttgtttataccggattctacaacttatgtatcaccttcatcagctgctcacccagcccgatggtatatccttgtgacacaaataccacccggttaaaggtatcaccaatgataaacataggcaagatagtcttgttagacaacttcatgccttctgcaatctgcttctggatggaaccgtccacatcaataccgtaagtaatggtagccggtaatcccgggaattcctgcggacggaacttcttgtactgctcctcattggggaacaacagcacgattcctctgccccattcatcaaagtccttgcccaatgccgcgatatcgcgcaatgcatggttggtaggttcttgtccggcgcccagtacggctacaatgtagtaaccacgtcctatagtggcaagaatggacttcagttcatcgctatccatcggtttataagtagattccgagttgaaattaccgatcacctgaatatcatccttactttcacgcatcaccaagtccaccgtagtcgtttctcccggcttgatggtaaagaaagtcagctgggacaatacgccaccgttagccagacgagtaccggtcaccatcacataattgccggcatccagtgccgttccgttcttcaacagattagcccaagtagcgccgccacccatatcaatatcgccttcatcataattcagcaatttcaaagttccggcaggagtcagtctggaaatagagaaatgagaataatacttcggatcagccaaagacttgatcggcgtatatctggcaataagcttgccggtaggcgcactggcctgttccattgcttcgaaattcacatcaatagcaccttcatcgcctatcaactgcacttttcccgtcacttcgtctatacgtgcaggaatacccatgctgcgtgccatggatacaaagaagatatcacggctgtgcgcatcggctgtacgggccttccacaccccttccggagtgattggcgagccgcccaggttgcaatccttgtccacacggatattcccggcaacccatgcaaccagcttcatcggatcggcaaggtaagcctcacgatcctgttcgggcactgctttctcaaaaaaccctttatacggagtaatcatttcgttgctcacgcgcggattacgcacaaatctgcggaaataatcagcattggcgcacaagtgtgaattcatcatgtggtctatcaacacttcggagcttacatcacgaaggtctttggcagaaatctgctgaagcaggtcaatgccgcccttctttgacttgtccgaacggagacgggccataaagtcacggatggtttcgtagttgccacgtgatgccaccagcaatttggcaacggcatcctcatccagctggtattctttagcgaaattgcgagccgattcatccgtcatgaatgtagccacgtaggcattgcggatagagtcctccaaagccatgcggcgattgttctccgcacgttgttcgggagtcacttcgggcatattggcgccttccatcggaggaatgatatccatatccagtgtataagcctcgccggccgttttgtccagcttcacggtcaaggcattgtcttgtccgaaagacagtttggaataaccgaattttccatctttggaagcccataccagcatatccccttttccggcggtcaggaacgtcttaccgtccgcatccgtctgtttggaagctacggtataaaattcggcatagttatacaccttgaattccactttggcgtcagccaccggtttgccgtccgcatccacgatggtcacatcggcttttgccgtgggagcatagttgtcaatcacattgatttccgtataacggggagtacggtacatcacttcttccggtccgttataacgtccgaacaccttggtgtgcatcagcataccccgtgaagcgggagcgttgaaccaacccagattcagtaccggttcgggctcgcaagcacccaggaagtaccatttgccatccacccaagcttccacccaggcatgattgtcgtcggtatgtgcccaacgcggcgtatatacctgacgggcaggaatacctaccgaacgcaaggcagctaccgtgaacgtagattcctcgccacaacgtccgtaggctgtctttacggaagccagcggactactggtacgggcatcagagggggtataaatcaccttttcatgacaccagtggttcacttccagcacggcatcatataaagaaaggtttttcactctgtccttcagctcctcgtagaataccttacggctgtcgtccagattctcgttgtttacgcggatgggcaatacaaagtggcggaactctcgttcgggaaccacttttccccacggcatctcctcacgcgccttgaaggcgtagtccacattttccagatagaattcaccgggatggtccgctatatccgccaagggcatataggcgtaaaggaaagtcatcgcctccttctgttcatcgctcatgggttgttcgaatacctggaagaggttaccttgggtcagcgtatcacgccgtgcctcaaaatcctgctgaacagcggcgcgttcagcctcatcactgatcaaatgtttgttgtttgtacacgaggcgcacagcatcaagcctatccccgccgcacacagagccaataatttcatcttgttgtttatttaggttagcaatttgttattggctacgaagataagacttttttcttatttttgacgaagttcaagctattatttagtatccgccggctccgattgttgagattgataatattcctccttccgcttgttggcctgctgcaccagactggtgacgtataccgtgaagatagggaacatcatcattcccagggcggccagcaccaccgacagtattttccccgtaggagtgacggcataaatattactccctacggtggtaacatccataaaggcccaccacagcgcactccagtagtccgtcaccatagggttcaccttatgttccagcacaaagaagataagactggcaaaatacacggtggccatcagcatggtgatgtacgaggtaaacaacccggacgctttgctgcccgacagccagcccaccacgatggctagtgcataccctcccctcagcaaagggataaagcgcaggaaataactgatttcgggcgagaaagtgatgtgatagaaatcaatgatatttaaataaggtatagataccagcagaaaaataaaatggctggtgaagtaccttcctttttctttcgagaggaaaaactccagcaggaaatcgaacaggaaaaacatgcatatccagaactgaatcttcagataagaaccttgattcaggaaagggatgttatgaaaagtatctatcgagatactgataaccagaaaaagggacatcaacaggatgaatatatgcaagatcccgtaaatccccctacgggaatagatgaatgaggagaaagctgttttcataaactatactgattatattattttttctagaaacacccttccgggtacgattgtttaattccgcataccttccgggttaataaacctaaacggataaacatcatttccaaggagttgttataaactccgtaaacaaaaaacatatattttttaaaacctaaactttatggcaaacattagtaaatcagtcaagctaggggtatttaccctcgctattatgaacgtgactgcggtagtatccctgcgcgggctgcctgccgaagccgaatacggactgagttcggcattttattatttattcgcggccatcgtcttcctgatacctacctcattggtagcggcggaactggcggccatgttccaggacaagcaaggcggtgtgttccgatgggtgggtgaagcctacggaaagaaattcggcttcctcgccatcttcctgcaatgggtggaaagcaccatctggtatcccaccgtattgactttcggagctgtggcactggcttttatcggcatgagtgacacccatgatatggccttggcatccaaccgctattactcactggcggtggtcttgattatctattggctggccactttcatttcgctgaaaggcatgggctgggtaggcaaagtggccaaagtaggcggtatggtaggtacgattattcctgccggcctgctgatggtactggcggtgatttaccttgcctccggcggacagagccagatgaacttcgacggcaactttttccccgacttcagcaacttcgacaacctggtgctggcttccagcatcttcctgttctatgccggtatggaaatgggcggtatccacgtaaaagacatagaaaatcctgccaagaactatccgaaagctgtattcatcggtgcggctattaccgtaatcatcttcgtgctcggcaccttcgcactggggatcattattcccgaaaaggatatcaacctgactcagagcctgctggtaggttttgataattacttcaagtatgtccatgcttcgtggttgtcacctatcatcgccgtggctttggcattcggtgtgctggcaggtgtgttgacctgggtggccggtccgtccaaaggtatcttcgcagtgggtaaagcaggctatctgcctcccttcttccagaagaccaacgccaacggcgtacagaaaaacattctgctggtccaaggccttgccgtaaccttgctcagcctgctgttcgttgtgatgccttccgtacagagtttctaccaaatcctgtcacagctcaccgtattgctctaccttatcatgtatctgctgatgttcagcggcgccatctatctgcgttacaatatgaaaaaggctcctcgcccattccgtatcggcagcaaaggcaacggactgatgtggctcatcggcggtctgggtttctgtggttcactactggcattcgtgctcagcttcattccccccagccagattgcggtaggcagcaacaccgtatggtttgccgttttgattatcggctgcatcgtggtagtcgcagctccgttcattatctatgcatcgcgcaaaccgtcatgggtagacaagaacacacagttcgaaccgttccactgggaagtacaggctacaacggcacagacagcggctccggtttccggcgcggctaaaagttccgcttcaagcgcctctacaaacgctgccgccggaccggcctctcaaagcaccccgaccccggagcaacacaaataacccccgctgacgggttagcccattcctttttatcacaggcaattccggttccttgaaaagcaagaagcatgtttttcaagaagccggaattgctgttttccacaaaccgggatggttactttccctctctcttccaataatttcctgtaaatcatagccggaattaaagaaacattcctatctttgtcccttggttcacttaataatcacgtttgacatgaagcataaagcctttttcatttttatgacagcccttcttatagggagtccgctttatgcacaaaaatataaaatagcccttatccattcctaccaggaagggtacagcggtgccggcattgtaaacaaactgtttgtcaaaggactgaaagaccagcaaatagacttccagctgcgcactttttatctggattgcgagaaatatgaatctgtagaagaagagcaacggatttccgagtttgcagattccatccgctcatgggaaggggatttgattgccgtgctcgatgatcaggcaacctactctatcatggcttgcggaaacccgtatgtcaggcagattcccgtcgtattcagcggagtgaattatcccaaccaagacttgctggcacaatatcccaacattacgggctacatagacaaacccgattacctcaccacctgccggatgatagaacgcattatgggcaaagtccgcatccacatcctgaacggccggaccgtgcttgaccgccttatctggaaagacctgagcgaacaatgcaaaggatcggaaatcaccctccaccaatggaaaagacaagaggccctgcccggcaagctgaatatccccatcagtgacaaagatgataccgaatatgaatccctgcacgaaaaactgaacgaatataaccacttggactccaccatcgtagtccgcctgtccagtgattccgtagctgcccgcgacctgatgtggctgtccagcgggatcttcaaatactccttgttcctgtataccaaacgggactataccaccctgcgcatcggcagcctgttcgacaatcccggcttcgaaaccatcaacgaaggattcgggataaaggaatatatgctgggaggttatttcgcccccatcgaaacacagctaagcgacatgaccgccggcatcaaagaaagactgcaaggaaagatacccgtcccggcagtaaaacaaatcgccaaacagcatctggtcaactggcaggccatgaagagataccagatcccccctgaaagcattccaccggaatataccatcatgtacaggccgtggagggaaaaatacgcaacccccatcctgattcttgcaagcctcctggtcttcacactccttgtggggatagcctaccttatttatatctatacactggaaaaaggacggaaaaaagaagccttgcgcaacctcaggttcgaacacgaagcattaacgcttgcactggaaggaggaaaaacctacgcctggtgtttcgacggaaaaacagccgtgttcgaccaagctttctgcgaactgaccaaccgttcccaaaacctgttggaaataaaggaaatagccaactatgtacaccccggcgaccaagcccagttcagaaaaaacgtatccaacatattacaccggccacgaagaacagcccaataccgttgcaaattcgacgacaccggttaccaatggtgggaattcagatacagcgtgttgcagcattatgaacaaaatcctatcatcaccggacttctggtaaacattcaggagatcaaagacaaggaagaagaactgatacgtgcccgcaaactggcggaacaggcggaactgaaacaatccttcctggccaacatgagccatgaaatccgtactccgcttaatgccatcgtgggattctccaacctgctcactaccgagaaaaacatctcggaagaagagaaaaaagaatttgcctccatcatagacaacaataccagactcttgttgaaactggtcaatgatgtgctggaactatcccgtatagaatccggcaatatgtcctttcattgtgaggattgcagcgcgcatcattttgcagaaacggtctatcagacccatcaggtaattattctccctcctgtggaattcatcaaagaatttcccgacgaggatgtgaccatacacatagaccgtatgcgcctcacccaagtcatcaccaactttttgggaaacgccaagaagttcacctcccaaggacacatcaaactgggttatttctgcgacaaagagaaaaaggaaatccatttcttcgtagaagataccggtgcgggaatccctaaagaagaattacaaatgatattcgaacggttctacaagcggaatgaatttgtacagggtgtaggactgggactcgccatcagcaaggtcattgtagaaaaaatgaacggacacatcgatgtgcaatccgaggtgaacaagggcagccgtttcaccgccgtactgccctatttgtaattttattcctgtgcaggctgtttaggcaaggcgaactgcaagaccagatacgccagcacacccgccagcaccgttcccagtatgacacccatctttgcctgcgtcagcaacaccggtgaatccccgaaagacaggttggctataaacaaagaaaccgtaaaaccgataccgcccaaaagacagacacctgtcaggttcacccaggtcatgcctttcagcagtccggcgaaccccatctttatcaccagccaggtaaagaaataaatgccggcaaacttacccgccagcaatcccgccagcaccgcccaagtagccatccccacttccaagccaccatgatccgccgtgagcgagacacccgcattggcaaaggcgaacaagggaagaataatataattcaccattccatgcagactgtcttccaatgactgcaagggagatatgacacggtccgaggaagactcgatgcttttcagcacattgatctgcatcttgcttaacacaacaccttccttgtcactggcaggaaagacagcaatgttctcccggatgcggttaatgtacttacctatcttgtaatgaggagtggcgggaaccgtgaaggctgcgacaactcccgcaatggtagcgtggatgccgctctgcaaaaacagataccacataatcactccccagaaaatataaaaccaacggttgcgcacccggaagaaattcccgccgcaaagtatcagcaggatacccgccgaagcaatcaggtagttcaccgccagatgagaagtgtaaaaaagagcgatgaccagaatgccgccgatatcatcgaccacagcgaaagcagtcagaaagactttcaagctcagcggaacccgcttgccgaacaggctgagcactcccagcgaaaaagcgatatccgtagccatcggtatggccaggccactttgggccggagttcccgccgtcatgaaataatagatcagcaccggaaccagcataccgccgcacgccgccacgatgggcaaaagcgcctgccggaaactggacaattcgcccaccagtatctcacgctttatctccagtcccacactgaagaaaaagacagccatcaaagcatcgttgataaaagtcatcaaggtcatgtgatgcccgttatgactaaagaaattaaattctcctatctgaagatgcacttcgtaattccaaaaggaggcataaatatccccccacggagaattggccaggaacatagccagcaagactacccccatcagcaacatccctccattaatatgatagtgcgccgctcgctggaaggaaaagttcaagttcagaattttcagtttttccatatcaattgaatttaagagtttgtgataaattgccatcaaaacacaagccctttctgttattgactttttaatttcaactaacagaaagagcccgcttattgtttgctcctcagagcttgttttattcttgaattaatccagcttcagaacggccaggaacgccttttgcggtacttccacattaccgatctgtttcattcgtttcttacctcttttttgtttttccaacaatttacgcttacggctcacgtcaccgccataacacttcgcggtcacatccttgcgcaccgccttgatagtttcccttgagataatcttggccccgatagctgcctggatagcaatatcaaactgctggcgcggaatcagctctttcagtttctcgcacatacgcttgcccaggttataggcattgtccacatgggtcagggtagaaagcgcatccaccggctcaccgttcaacaagatatccagcttcaccagtttggaagggcggaaacccgactgatggtagtcaaaggaagcatatcctttcgaaatactcttcagcttgtcataaaaatcaatcacgatttcacccagcggcatcttgtagtgaatctccacccggttgcccgacacataattctgccgcaccaattcgccacgcttgcccagacacagcgtcatgatagggccgatgtaatcggtggcggtaatgatcgtggcgtcaatgaaaggttcctcgatgtggtcaatcagcgtcggatcgggcataccgccgggattatgtacctcattggcatgtccctgcttgtcatataccatgtacgacacgttgggcacggtcgtgatcacattcatatcaaactcgcggtccagacgttcctgaacgatttccatgtgaagtaatcccaggaaaccgcaacggaatccgaatcccagagccagtgaggactccggctggaaagtcagcgaggcgtcattcagctgaagtttctccagcgaggcgcggaggttctcgtaatcttccgcctcgataggatagaccccggcaaacaccatcggcttcacttcctcgaatccggcaatcgccttgtcacacggacgggcaatgtgagtgatggtatcccccaccttcacctcgcgcgaagtcttgatgcccgaaatgatataccctacgtctcctgtacgcaactccgtgcggggaatcatgtccattttcagcacaccgatttcatctgcatcatactccttgccggtattgaaaaatttcaccttgtcccctttgcggatcacgccgttctctattttaaaataagcgatgattccacggaaagaattgaataccgagtcgaaaatcaaagcctgtagcggcgcctcctcgtcacccgtcgggtgcgggatacgttccaccaccgctttcaatatctcctccacacccattccggttttgccggaggcacggataatatcctcacgtttgcagcccagcaggtcgatgatttcatcttccacctcatcgggcatggcactcgccatatcacatttgttcagcacgggaatgatttccaggtcatgctccaacgccatgtacagattcgagatagtctgcgcctgcactccctgcgaagcgtccacaatgagcagcgccccttcacaggcggctatggaacgggatacctcgtatgaaaagtccacgtgtcccggagtgtcaatcagattcagtacatacttctctcccccatactcgtattccatctggatggcatggcttttgatcgtaatacctctctccttttccaggtccatatcgtcaagcatctgtccttcggttacctgaatggtttttgtgaactctaacaaacggtcggccaaggtggacttcccgtggtctatatgtgctataatgcaaaaattacggatattcttcatctttaacagctatctatttaaaaaacaagtttcttgctttccgggcgcaaagatacgtaaaaagaacaagattttaaagactataataaatttatagcagacaattccctactcaaagactgtatgcctttctggatcttttccaactgctgcctgcgaggtttatgcactccggctgcataatgccacaactgacgttcattgattccggtaatccggctcaaagcagccttggtgaagatgctgctataatagttgataaaagtagcggcatctatcttaaatttcaattcaaactctcccgacaagacttcacaaggattcggattatcttccagatacaactcaattgcctccttcatgttatcctcaatctcctttatgtcattgcctacagtaataacgggagcaccttcgatataagcactcaagttctttcctgcgtgttctacaatcacttccactgttttcataatacaaaaccgttttccagcaacatcgttacaacgtctttcactgatttgtaactcataacgttttggacttaattaccctgcaaatatagtaataatacgaatactattcaaagaaatgattcatcattttactataatatacaaaaaaatgcgttgacaacatacaaaacgatgtgccaacgcatttttttatgagtttaaaatcttcttcttacactaattttacaaagatctcgccttccacttcagaagtaacgaccttatcttctctcagtaaccagcccagccccaggaagaaatccttgtcagctttcagtttggctgctttcttgatttgtttttgtgtcaaaccttcagttccattcaatgcttcccagatctgtccggccaaagcacctgctttttctttcaacattttcaatttgcttttagttaaacgttaaccgcacccacacattcctatgtgaatgtttgtgtttcttatcgcttgcaaagatacacaaaattatgttattcaacacttttgcatcaaaaaagtttgtatttctataagaaaaagcgatttttcaacctattttttttgtttttcgaggtgttcgctccaaatcctggccgcttcctctaccattcttgcacaaggacgcttggcataatactgttccgtccttgcttccggcgtggatactaccggctcttttctggacaatcccagcaaatcggcacaccgcagggcgccgttccgcttcttgaattcttcggccagttcctgcaccagagcgtaattcgccgccttgctctcacggtctttcccctcgacggcgcacttctccagcccggccagcaggaacatgccgcaagcagcaccgcaggtctcacgcatccgccctataccgccgccgaaagaggcggacatgtgcagggcctgttcacgggtgaaaccatacagatcggcaaaagccgtcactacggactgggagcagttatatccttccctgaacaaagctacagcctttgccactctatcttcttccctaacttccggatgcaaacccaacgtattcttgtcttcctccattcttctcacctccttcttttcttcccgtctttttcctttgttctcattccgccacattatttacaatctcacccttgataaatcctttcaagttccccaccgcaatctgcatcagccggacacgggcttctttcgtggcccaggcgatatgcggcgtaatgaagcagttcttcgccgtcagcaaggggttggtatattggggaggctcggaagaaagcacgtccagtccggcagccgctatcacgcccttgttcagtgcgtcggccaggtctttctcgtttaccaagggaccgcggccggtatttatcagaatggctgtcggtttcataagggccaggcgggtggcattgaccagttctttggtatcgggggtaagggggcagtgcaggctcaccacgtcacattcgcggaaaagctcatccagctccattttccggattcctccgggaagttgtgactgcggcttggaagtataggcgcatacctgcattccgaaagcggcagcaatgcgcgccgtcgcctgtccggtgtttcccaagccgatgattcccagcttcttcccgtccagttccaccaggtcggtatcccaatagcagaagtcgggattatttgcccaacgcccgtgacggttggcataggcataatggcctacacgctgggtgatgttcagtatatgcgcaaagaccatctgggcaacggaagcggtgctgtaggcaggtatgttggtgacaatgatgccccgcgctttcgcagcctggatgtccacaatattatatcctgtagccagcacgccgatgtatttcaaggcgggcagagcggccatatcctccgccgtaatcaccgttttatttgtaatcagcacttccgctccggcagaacgctccaataactcggcaggggccgtgcggtcatataccgtcagctcgcccaacgcctgcatctcctcccatgacaaatcaccgggattcaatccgtaaccgtctaaaactactattttcatattttcaaaaattaaatttcatattttgttcatttattcggttagattggaacgcgaatgacgcaaattaacagctgcacagcatggatataaaccggccggaaggttggatttatgtcatttgcgttccaatttttaattttatagcacaggatcaatgcaattcattttcattccttgaaccgttccccccagaggctctgcatccgttcctttatcttcgcttcctgcgcattgttctgcggatgccagatgcggctgcccttcacctcgtccggcaggaactgctgctgcacgaaattgccctgataggcatgtgcatacttataatccttgccatagcccaactgtttcatcagcttggtgggtgcgttgcgcagatgcaagggaacaggcaggttacccgtctgccgcaccagttccagggcgctgttgatcccctcgtatgccgagttgctcttagggctggtggccagatacaccgtagcttccgccagcgggatacgcccctcaggccatcctatcttcatcacggcatcaaaagcagcgttcgccaggagcaatgcgttgggattggccagaccgatatcctcggctgccgaaatgactagcctgcgggctatgaaagccgggtcctctccggcctccaccatacgcgccagccagtagagcgccccgtccggatcacttccgcggatggacttgataaaggcggaaatgatatcataatgcatctctccatccttgtcatacgccaacggattctgctgcagacgctcggtcaccttctcatccgtaatcacaatggttccggcatccgcatccgcttccaccaccaattccagtatgttcagcaacttgcgggcatcgcctcccgaaaagcggagcatggcatccgtctccttcagctctatcttcttttctttcagtatcacatcctttgcgatggcattatgcagcagttccagcaaatcttccttctccaatgatttcaacacatacaactgacagcgggagagcaagggccggatcacctcgaacgagggattctcggtggtggcgcctatcagggtcaccactcccgtctccaccgcccccaacaaggaatcctgctgggacttgctgaaccggtggatttcatcaatgaacaggatggggctggcctgcgagaaaaaacggttgcttctcgccttctctatcacatcgcgcacatccttcacaccggaagtgaccgcgctcagtgtataaaaaggagtttccagcttgttggctatgatctgcgccagcgtagtctttcccacccccggaggcccccaaaggataaaggaggagatgcgtcccgcatcaatcatcttgcgcaagacagcccccggccccaccaggtgtttctgacctatataatcgtccaatgtcttcggacgcaaacgttctgctaaaggttgtgccatatcttcatctttatttcggataacaaaaatacagcatattttccgatgaacaaagcccagggcaacaatataggatttatttttttaaggcagaaaaacaaaagaacataaaaaacagggactcatataaaatgcaatacgggttctttgttcatctgatctaaaacaattatttttgcaaccctttttcaaaagagtgattatttcaaatttaaatgtaattctaataaaaacagacgatgaaaaaacttttttccaccagcctgttgattttagcaggtatgcttttactgctgggcggctgcaaagaggacgaacttccggtttccggagaaggaaacgtggcaaacaatgaattgcccgtccggctggccgaaacggattataacccggacaacacgtattacctgctgaatgacaatgaatcccaggatgtttatttcgactccggccagcgcagcttctacgtcagccggcctcttcagttcggaatggacgacgagcactgtttccaactccgtttctatagtcccagggccttgaaaaacgtgactttctgggccaggatagacggttacgaggaagaattcaagttcatgtcgctggaaaagatcatgcctttccagcaactccgggtacacataccgttcgccaccaaggacctgaccgcctatacccgcagcggaaagaaaatacggatcatggcaaacccctacctcacggaagaaaacctgaccttcaccgtagagtgtgacgacccgtactgggcaaggctgcaatccatccggtgcaaatggtacatcgccttcggcagatacagtgacacccaggacagctggaagtacaagatgaaggcttcgcacacgcgtgaggcggtggccatcgcgctgaacatggcgtatatgttctcgtcggaacggttcaagaccgccctgtacgagttcggcccgctgcacagcaacaatgacaaggcggaaatagacaagaccgccctgctggccaacgtgctcaaccaccgcggactgaccttcggctataccaccggcgtgatgggactgggcggaggaaccaccttcggcatgcatgaagtgtgttatctggaacactatgccgatgacaaaagcatcaccgaaaccatcttccacgagtttgcccactgtgtgggctacggccatgcgggaaacatgacttacgaacagacgggaccggggtggatcaccctgtgcaacaacgtatatgtggcgctgtcgctggacaaggagctgcccgtctattcccgccgcttcctgcacacccgctggagcaggaaccgttattttgatgatatatacgtggcttcgaaacacattatcgaagacccggaactcgatgcgctggacggcggcctgtctcccctgcgcggagagaccgaccggggaggaaacgacggggagccggtggcgttcaagctggattataccgacttgcccggcgctacgggaaccaccttccgccccaaggatgtatatgtgtacggagataccctgtatgccgtgaacgatgcggacaaccagtacagcgtagaggtgttcggccttgccggcggcggcaagaagcacttgggaagcatcaaggaatggaagcacggagaagctaccgggaaattcggcggccgcccgaacggtatcacccgtgcccacgacaagatttatgtcacccacgaaggaagccgtaccgagatttttgatgcgaagagccatcagttccttacctgcataggcaatggaagctggggaacggggcccacgcagaccgtacatgccttcgatgtgctgctctacaaagggctggtcatgatacacgacaaacgctacgtcaactttgtagaagagcaggctatacagtccggagtgactccgcggatttatgtacgttccgaacatctgggcgaaacaaacggcacttacggcatggcggtggacgaacagaccggcctgctctactccacccatcccgccaaacgcatagacctgttcgcccccgacgggatacgggaaggagtttcacccaaacgcaccgggcaactggcttataaaaatgtaccctacgacttggatttctacgaaggaaggctgtttgtaagttccaacggcacagaaaagttctgtgaggtcaatccccggacgggagagatcgtgaaggaccataccaccatcggcggcatcaccctgcaagcacccgagaagttctgcatccgccgccacacgctgttcatcaccgaccgcgtgaaaaacgggacatgcgtttacgccatccccatgagtgagctgaaataaatatatacctatataatatagtaagaacaacatgaaaatatacgcttatatcctgattgtgctgtccggagtcctgacggcacaatgcagcaaagtcaccctggatgaaatctgcggctacccctccgctcccggcgaaggaaacggggaaggagaaggaaacggggattataacagttactggtattactcgtatgaggcggcgcagctgattgatgcggaaactctgggcatggaaacggccgaggatttcaccccttataccgttgcccatctgggggatacccttttcatcgcaaacatcggaaaggcaggcagcagcctgttgctgttcagtataaagaaaggtgaacggctgggaaccttgcagagctggcagcacgatggcggggagaagagtttcggaagtcagatagaagccatcgtgccgtcgggcaaccggctgtatgtggccgaacgccagtcgcgcatccatgtgttccggttgccggaactatcctacctcacctgcataggcaacgggcaatggagcggccccgtattccaggcacaggccatgacggtaaaggacgggctgattttcgcacgcgacaagaacggaatggtcagcatttacaaagaggaggatgccaccccggaaaattaccagaaggtgaaccgctaccgccgggcatccggcaacggcagtccgggcaacaacggctttgccagccattccatgcagcccgatgcggaagggcatctgctgctcacggattatgaagggaagaaaatacgggtgctcgatccggcactggtcaacgatgatatggcaaacgacgcttccatcgatctggacgacctttccctgtcgcccggcttcaagcccaagacactggcgttgtgcggcgaccgctggtatgctaccggcgacaatgatgccatcaacatatacgaacgccagtccaacgaatggagcaagaaaataaaaactgtaaaaggatatgctttttcccagcctgcccgcatctatgcgcaaaacgactctgtgctatgggtttcggacacgcacagttccaaacggacactggtgaaaatgctggtgcataagggagaaatacgggaatagaggttctattccgttctttatccagaatgtgaatgacacgaatggcgcaaattgggtttatatctctgattggcgtcattcgtgtcattttcattcacatatatcaaccttgccaatctttcaatgcgactgtcaacaggagccggtcgttcacttgccatatcgattacgcaatcggggaagccattctttttatctggccgcactccatcacaatcccctttcaaggctcccctatcgcccccacaatcagctgtacctgagccggcatataggtacggcagctcaagccactgcccatcttctccagttgctccctgaggtgaggataatagtcaatccaatactgcaacttacggtaagccacctgcggattcaaatccgggaaataacacagggccagttcagtgcggccatacgtgcgtatctcaaaattctccatacattccatactttttatttacttccataaaagtacgaaaaacggacgagaagaaagaatgtttttccaacaataatcaactagaatcaactgttatcaactacaatccaccggaatcaactttccggaatccgcacatcgtatctttgtaatgtcgggacgatgaaggcgaaagatctataatcttacagctgtaagatataggatcttacacgtgaaagatagggttctttcagcagtcggcaaccagtggcagacggttaatggacagtgactgacggctgacttacttcattccccggcaacagtgtttcttaattctcaattatcaacttttaattttaacagactatggtaaattacagtatcgttatgcgtagcaatccgatggacgtggacgccgccaagaaggcctacgccagtgcacagtatgctgaagtgatggacatcaaccgctttgccgagcacattgccagccacggctgtgtgtacaagcgtgcggacatcgtggctatcctcaccatggcagtggactgcatgagggaacagcttctgggaggacagaagatacagctgggcgacttgggggatttctccatcagcatcaacagtataggagcggaaagcgctgccgactacaatcctgccatccatgtcagaaagctgaatgtgaactggagtgccggaacacgtttccagaacttgcaggaggaagctgtgttcaatctggtggccacgcgcaaggcggcccgactggtggtgaaggcgctgaaagccggaaagaccagtgtggatcttaccggagaggcgaaggagccggaaaacggaggacaggcctgacggaactcctgtacgacggaggcaagacacgacgctaaagggctgaatgtgccccaatgaaaaacggcttgtcataggggcacattcagcccttggcttccattacaattcacttattatcaacctctaaaacaaaattccaatgagttcaagaacaaagaaaaacacctggacactgattctgaaagtaattatcaccgtagccaccgccgttgccggcgcactcggcctgaacgcctgcatctgatgaacaggagaaccatcaccctgattattatccactgctccgccacccctgaggggcggaggctggattttgagacctgccgccaggaccacatccgccaccggggcttcacggacataggatatcatttctatatcacccgcgacggagagattcaccgcggacgacctctggaaaaggtgggagcgcattgcaagaaccacaaccggcattctatcggcatctgctatgagggcggactctcggcggactgcacacctgccgatacgcgtactctgatgcagaagggaagtatgctggcactgctgcgcgagctgcgcctcctgttccccaaagcgttgatagtggggcatcatgacctgaatcccgtgaaaccgtgtccttgttttgatgctgtaaaggaataccgcttttaaaggtgcttttctccaaagataacgtccctttcctccgctttgatttcctgacccttattcaactaatcttttcatttaacaataataaaaatgaactatctgataaaccaactcatgaccgtggacaaagccttctaccgtcattatctggaaatgctgctcaccctgaaccgcatccatgccctcaccccctggcagatgtccatgctgctgtggagagccaagattttccatatacaggtgctctatcccgaactgctgcgcatcagcctgtgcacggagcaggagaaagacgaaatacgttttatgaaaggatggaaactgaaagagctggagaaaataatgcccgcatggcagcgacggcagtgcgaggagataaaacgggaacggtggagaggattttaatggctagtgattaatgaggaatgatcagtgatcactgaggaatggtcagtaatcagtaaaacctgccggcaacatgatctacttgtaagcaacttttaaaagggatatgtcaaaataaaataactactccaaaaagttacagactgtaactacaagacctaaaaggcgagtgtcaaaactcagtttttgaaaacatgaacttataatctgaaatttgagcatcctaaaagactaaagaaagggtcgtatcattactccatacagagcttgatacgccccttttacgtgttataattactatctgtaacttttcggggctgtcctttttgttttgacatatctcccttctcctatccctgagttattcaggaacagcaacattcaacttcttcattccccctcattaaaccccaggccctgctgttcgggcttcagcttctctgtcaggaaattggtatgctcccacttcggttcgggcggattatgatccaaggtcctctcctcggtaggcgtgtagcgtccgttgtaagtgctgaaggcgaaaaaagcatctcccggtccgcccagatggtcgaaacgtaccttggccacacgcaccagcacctgccccagttcatcgttacggtctaccaccattccataatccgtcttgttgaaaaaggccgccgagccgttgatatcatacagcgtgggcacaggccagcgtttgcttcccggttcgcggcgcaacttggtggggtgcgccaccagaatgagcaacaccttgtgcttcacggcaaaattggagaactcgtcgaagatgcggctgatgtactgcgtttccgtttcccagtcgggaatctgatgctcgaagcggttgaaggggtccaccaccagcaccttcactcctttccggctcaccagttgggcggcaatgcggagcacgctctctaccgagaagtcctctttcggcataatggagaagacactctgtgccaggtaacggatggcctgtccggcttccggcaacggcatccccttgtgttcgaaacgcttgcccaccacgcggcgtatcagcttgcggtagtgataggccagcggggtattctccgggctgaaatagcccaccttccaatcgtggcgcaggagcaggcgcatggcaatttcgtccacaaactcgctttttccgctgccgggaacgcctgtgaccgtgagcacaaaaccacgctcgaacttgatcagccggtccagattctccagtcccgtatcggctccttccggcattccgttgtaataaatatccatcagcgtatcccattcgtccatagggcagaagactccttccaacgggatttccgccgcctgctccacctgctggcggagcctcggaagatcgtacttcaacagatactcgttggcatccttgcagccttctccccaggccaccaccttgcagcggtccacgcccaggcggcgcaccagttcgtcgcgcaactccactccgcgcctgtcggtatccatggccaggatgatttccgtcttgtcatcgaagtgcgactccacgaagcggtccagccactgaaggttcgcgcctccggctccgttgggtacggacaccacttcttccagtcctgcggctatcaggctgagggcatctatctcgccttcggtgatgtagcacttttccttcccttttatggcgtctatgttccaaggaatcagttcggctcctttcaccatcttgaaatgctttgcggcatcccggaatttcatgtttttcattactccgtcctccaggtaagggaagcagatgcaggcttcttccttgccggtctgcggcaggaattccaagcgttcctctatcttcatccttgtcaggacgtccatcggaatacctcgtctgccgaccatgtattccatcatttttccattcataatttgtttgtttttattgattaccgggcatatgtaatgtacaggcggttgcagggggatgtgcggtttgcgttgcgccgtgttacggtgctgcgatgctgcatcgtggtgctgcgacgtgttacgttgctgcgatgctgcatcgtggtgctgcgacgtgttatggtactgcggtgctgtaccgtgatgctgcgccgtgttacgttgctgcggtgctgcatcgtggtgctgcgacgtgttatggtgctgcgatgcatccttctgctgtttctgccgtttccggtcttgttgtttctgttctcttttccacatctcgtcctcgttccacgctatggcgaaatcacaatgaaagcatttcgcccatcccccttcacgggtgatatgcacactgaacgaaggatctttgggattgcttcgcgttgcggaacattcgggacaaggcatacggaaatggtcctttctgcgcggcaggcttttcagccaccgcacatagtctgcatgttcttcgcgcgtcatatccagctctgtttcaggttatcccaggtggcacgtccgttggggcgcggtggtgcaccggcaggaagaggcacaccgcagtacgaacgttcgccggtcagcggattgtacgtttcgtagggcgagagtgatgtcgattcattttgcatccggctcctttctttcagcttttcttccagaaaaagacgggtgggcctttctcggcggatgtagttggcgaaataagcttcggcttcggacacggaagtgattcctcctgtgtttccttgtgccacgacatgtttcttgaacagatcacgaataaaagaaagattgtttaaaaagagttccttcaaacctgacatcatccccacagcctccagccaactctgggtaatgaaagcttcattgatgcattgttcccatcggggtatcgtttcagacaattcggaaaatcggggaagtttatcaacagcagcaacagcaattatttctttttctttgttattgttgtttttcttctctcctctattcttttcttctcttataaagttttgcttaaagcttgcttgcaatccctttccatatcgctcattatcaacactttgaatcacatttttgactgaatttccatttgtattttttgcagtcgtatttttcatactttccgcactacttttcacgttgctctccgtgctgttttccttgtagatttccttattataatccgaatggattggcttgctgttatccatgcagacaaccttgtcactatctacattgctgctttccatataaattctctccttgctatccatactgggtgcaccaccatttttcatgtagatttcctcgttgcgatccatgcaggacgcatcaccgcttttcatgtagatttcctcgttgcaatccatgcaaggtgcaccaccacttttcaggtaggctttcccgttattatccatgcaggacgtatcaccgtttttcatgtagacttcctcgttacgatccacgcaaggtgtatcaccactttccatgtagatttccttgttattattcacgcagggtgcaccactgcttttcgtatagatttccttgttattatccatgcaaggtgtatcatcgcttttcatgtagacttccccgttattatccacgcaggacgcatcaccgtttttcccctcgttgattctgcccctccctattgcagacgctgtagacgcagttgcttttgcagatgctttcaccgtacttttcttacagcttctccctcccttactaccggcagcagcacgttgctcggaaagtttactctgatatcccatcacctcgtccagatacagacatcggaaatacccgtcctctgtaatgagaaacaaatcgaagtccttaataagatgttgcagattttccacggtagctccccactgatcggccagcaaatccagttcgttaaaatcatgtttgtattcctgctgtttgcgcagaaacaatatcgtttcaagatacaaccccagccccatgcatttcatgtcggcattcagcttcatcattttgtaatccgacatcaaactgcaattcagccggataaactgctctgtataatccatttcttttgtgtgttagtataaatataacgcaaaggaacgcaaaatataaatagggcgttgctcacaaaaacaagcaattgttaataaacatttcctatctttgccgagacattttgtaagtagctatgtttatgctgtttacaaatcattatttaataatttaatttttagtaacatgaaaaaaatttgagatcatcagcacctgcatcggtaatgccgtgcgaagaaacgatttaaaccccaacaacttgggcgacaaaggtgcgataggccggtccaccgccaccaaaattcgggacggcaagattgtgactccaaattcttacttcaaactgatgaaatggctggaaaaggagaaaccggaagtttacaaagaagccatggagcacatcctgaaagaactgggcaagctcaagatggaagagtaacctcccggcttcccggaaacgggaattttccccggtaaacgtggagaaacgggaaaccgccatagagcgcctctgcatggagactgcctctatggcggtttttgcacccgggatagctgttttattatctttgcaacagttggatataagaaaggtaaaccctcaaattagggtttacgtaaatcatctgcatattcctcagccgacatatttccgccccaatcgccttcgtaacaagcaaaaggatcttctgtttcaatattctgttcctttgtatacgtatttctgatggaatttgtcagttttgcaatcaaatccggtttttcatctacactcagtgaagacaatacactcatatacacatctgttatacttatatttccaaccataaatcctccttttttataaaagaacagaatctattccgaagatcctaatcggataatcttttttatcatttcagatggattttgaagtaaatgccaccggagaaatatttcccgttgttcagttcggcaatcaggttgatgtggtctttccaaagctggtagtgtgccccgatgtttactgtgcgggcgtcatattcggccattaggttaagattatttacagctttaatcaaaggctggtcaccgagtagctgaaaacggaagtttgtgccgaatgaaggacgtttataatgctccatacctttggcattaccatatacaaatgcggcatgaataccccattcacctatgttctgaaaatccagatgtttggttacagccagataataccgtgttgcgtagttattggaaccgcttgtattaccagacaccagtccaccgccgccatgatcggcatgagaagtgggatcatccaagccgagtacgatttgcggtgtccactccttccaccacccttctttccaaagacgcagacgcgcactgaaagcccggtcctgattcgtgaatttcccccaagactgttccgggaaataagtagagccatgatccgcatgtaccaatgtacagatataggccacctccagccaaggaaaaatagtaatattaatgtaataattgaaggtataccccacttcactgctacgaaaatgggtggataacggatgagtattcaaatagtttccaccaaacaggaacgttttatcacgctgcatatcagccgtgggagcatgaagcagtccggtagtccccagcaatgcctgggcatcggcccataaggaaacactacacagaaaaacaagcaataagattcttttcatcaagctactccttacatatattccacatgaacaacagattgccgataatgtaacgtttccacatccggcgaggttctttcaacaaccggtagcaccattccagagaatgtctctgccaccaggtgggagcacgctttaccgttccggcatagaaatcgaaaacagcacctatcgttccgcaatggcaatggatttttaattcatgccaatgcgtgtacgcccatttctcctgcttgggggcagtcatccctatccagagcaaatcaggatttgccttgttgatagcttcgactatcgcccgattgtcctcttccgaaaactccggcttatagggtggcgaataggtttccacttcgatgttgggataatccactttcacacgctgttttatcaatgccaatactttttcactgctgcccatgaaaaaacattttcctccgatagtattcagcttgttcatctcgaactcgaacaggttccagccggcaatacgctctgtaggtttggatctcgcattcagccaacgacacgccttgacaatacttgccccgtcgggaattaacacatctccctgctgcaaagcttcggcaaagagcttgtctttttgggcggtattgtaggaatgggcgttgatggtgttgattaggagtttgccggaaggcaaagtggtcagccctcgatggctttccaacaagggtaagttttttaacttcaataacatgaatattgtttcgataattaaattttgatacggctatactcctaccttatctattttttctttcactataaggtgatacacgttgtatatacttatgctccataaatttctgttccaacctcatagctattttatttcctctcacataaagccataatccattcagaatcacctttaccttattctgtggatacatttcaaaaccatcaattttaatccccaaatagttaatatatacaaatgtgagcaattctgcgtattgtttgataaaagtttcgactaccactttggttaaatacttactataaacaaatatcagttttccgttctcgactttcacgttcacaccattataatgaaaaaacacaataggccaccgcctaccctgatgtattaaaaatccttcattaaaatgataatcatactgctcaatattccaattagcaatgcccacacctctattttcaatagcatacacattactaaacatatttttcatataatcgaggtatttttgatcaccatatttaccatcttccagttttgaataacaccatttcagacattcattcttccaccaatttaaacatttttcaccatcttcatcccgcttaaaataaacatattgtacacagtaaacaccaaatatagtattattaataaaatggggcgtaagaccaacagaagcatttgccttttttaattcattatccacacatttgggagaacagaaaaacatcaaatcagaatccaaataagttatttcaggtagcatacgtgttctaaaaaaatgctctgttaccacagaaccacaagtccaacaatattcagccctagaacgattctgtttagcctcaagtaatgaccctgtttcaatatcttcaatacattctacatgcatatgcgcaaaatccatatttttcaacattttctcacacttcctatccatcgccattacatacaacagaaaatcatccgtatgcctctcaagtgaaagatataatgctattcctttactaatataattggaatcaaagagcgtacaataatacaacatggtattatcttttattatctaaatgagttcaacacatcaaccacaatcttagcctctgcctccgtcacgacctgactcatcggaatggaaagttcctgttgatgaatcatttctgtaataggataagtccgattattccatgctttataacattcctgcttatgtggaggtatcggataatgaatgagagtttgtactccattttcctttaaatattcttgcaattcatcacgacgctgacaaaaaatagggaattgatgataaacattacattcatccttaatccgtttcggcaaaattatgaagcgattattgatgtgggtataatagtaatcagccaatttctggcgctgtgcattatcttcatccaaatattttagttttacatcaagtactgctgcgtctgtttcagccatacggctattcattcctacatatttaaatacatattttttatgacttccataatttgctaatgcacgaataatttcagccaattttggatcacttgtagttacagcacctgcatcacctaacgcacccaaattttttcccggataaaaactatgtgccgctgcatcacctaacgcaccggttttaacaccatcccaagcacaaccatggctttgtgcacaatcctccattaacttcaaattatatttctcgcaaattccacgtaacttatcattataggcaatacgaccgtatagatgaactatcattacccctttggttttagaagtaatgtgttcctcaatggcatctatgtttatctccaaatgatcccacgttggctccacaagtacaggtacaagattattgtctgtaatggcaagaattgtagcaatatacgtattggcaggcacaatgatttcatctccatcttgcatcaatcccatttccttataaccacgcaatataagttttaatgcatccaaaccatttgctacagttacacaaaactctgtaccgatatattttgcatagtccatctcaaaccgtttattttcatttccctgtaaaaaccaaccggattcaacaaccctgtctatagcagctttaatctcatcaccatgtcgcatagtgattgcttgtaaatctaaaaatttcaccatatcccacttattattcaatcgatatacaatcattatatcaaatcaattattcttttgttcctcaacatatttcagaaattcatcatagtcacgaatataatcctcttccgaatatccatgactagctaataccaagcagatactacccgatgaaaaaccttgttctgacgcccatattcccggcggcacatgcaacccccaaaatggacgattaagtaatacagtacgtttgtttacaccgtcatccaatacaacttcaaaagagccggatgctgctattataaactgatggcattccttatgcgcatgagcaccacgatcttcaccacctggaatatcataactgtaaaatactctgtttattggaaatggcacatgcacattctcgtatataaaagtcaaattaccttccggatcatgtgatttgttaagttcatatagcgaacaatcaaagacacttctcattttagtacccattttttaaattcctgataatccattatgtagtcattaacattgtaatcagttgatgacaagacaagagccaatgaatttgttgaaaaatttgtcattctgcgccatattcctttagtcacatataatcctttataagatctgtttaaaggaaaaacacatttattcttaccatcatccagtaccacatcaaacgaccccgacagggctactataaattcctggttctctttatatgcatgttctccacgatccattccgccgggcacatcatatatccaatagacccgctttatttcaaacggaatctgttttaattgctcaataattgacagattaccccgtggatctacaatctttggcaattcaataattttacagtcagttatatccattgctactatttaattaaatacattattctactgtaaattctaataaacaccgaattataccacatagcacgtttaaatagacaagaatttatactcaattgtgtaggccatacaaaattcttcttacccgtagattctaattcaaatttaaaacggctccaggatttacagttagtaccttgcccatcaaaacctctattattgataagactataacaagggttaacacacttcttattctgtaggaactgagcaaagacaaaacgtattgcccaagaattatttttacctttatgccaatcattcagcatcttccaagcatctgatcccgcccaacagcggaaaactcttgctttagatttatatatatcaaatggttctaacttccaatcaatagtatcccatctatctttccatgtggcccatccccatgaactacttctattataaatatacgcatcagccttataatctttgggaatttttatcttattattatacccacatatagaaaaaacaccatttactttctcataatattttaatccttgattcataaaagccaaaaaattaggttgaacacaaagatcatcttcaaggacaataacttttccatatcggtttattacttccgaaacgccatctataatacttgctcctaaccctttattcacttctgaaaatgtataatgtaatgtcttaaaacccgtaattgatatcacatactcccgtaccaattccacttctttcaactctccatctttatgtagtcttgctccatccacaaagatatataaatcactttccctagcttctgtgttctgcaacaacgaacaaaccacattccttaatgctttcggacgattaaaagcaaaaattattattggtgcatattgcatatttttataatgattaatcataagttaggtttcacttcaattcttgaatcaagaagcgttgcttaccccgattggttttctctatgaaatcgacgtaatgaattatcaactcaaaaccattacaaacaaaaagatttactatctctttctcaacattatcactatattctctagcctttactatatacatttccactttaccaacttcatactgatggagttgccaagtttgtatataattgaaggcccgaatatgtcccccaaagataaagccaacaagataaatcttttttcctcctttgttataaatacaatcaacctcacgtcccaatagctttgtaagaatagtttcacccaattctgtttctccaccatagattgcaagatcccctgtcttatatcggataaatggtaaaccatattcaacaaatcctgtcaccacaacttctccttgttcacctatattaacatgctgtcccttctgatcaacaacttctgtataaccatatataggagagcaataataaacttcatctgcaggattttgtatagcaaaaatagaactttccgtatgtccatactgtccataaacagggcatttgaagtaagaacttatgaagtttttctcatcctgtgtgaagctctcacttgtcaaataaacccctttcaatttcaaatccattacaatccctgtattcatagctaatttacacatttccatgatgccagacggatatccacgaataaatgcaggtttcgttcttttcaattcttcccaataatacttcacactattattatcaagataaagtgtagaaaaattcttctttccaaaaggaaaattagcgttccccatttgccaataaatattccgagatctatcttcatctttgattctgcaaccatcaaacgaaactataatatctccccactgatagcccatcttcatataaagcatcatttgacaaaccccttcaacaggcaagcctttatagagagcgggaaaatgcaaaggttcacccgtagatccacctgtattaagccatactttccaattatcagttatttcatcactataaacatttttctcctgatgacgaataatattcttatccaacaaaggaagactcttaattatttccattgaattatccatccttacttcacctactatatatttcctataataggtacaatgccgttgagcataactgagcatagctgttaacttagctagttgccactgtttccaagtttcaggatgattcaaaaatttcttagcatagtattgcatatatttcatatacaaccattgtatagatgaattagtctttaaatacttctgtaaataagttctattcatagcctatattattactttgagatttttcgtaaaaatctatatatatcaacggcatgaccttgcctaagaataaccataaaagaaaatattttagctttccaattaccatattccataagaagagacatatatcctttttcggctgaaaaaaaattattgacctcttcttgttcctttttatttccattatggacggattcaaggagaaaatagatcataggaataatactttgagagaaagcccaagcatgttctttcctaacgtgactttttaaataaacaaatagtgaattacatacaatttctagacttttaaatctcttaggattatacgaatgtgtaatagattccgatctaatggaatagttgtaaagaggaatatgaatacatttcattttagaagcaatatatacaactttgggcattatttcattatcttcatgtagaatcccttcataaaacataaaattattctttttccaaaaggaacgtaatataatataatagggagcacagcataatggcattttaaatgccataaattgaactccatttagctctccatcaaaatcattacgaacaataagctgtttcttattttcaataatatgataaactttagattgataaacaagttcagtatgtccgtcaagaataggaatcaattcatctataccccctttagctatccaatcgtcagaatctacaaaccaaatatactctccttttgaatgtctaacccctgtgttacgcgcagcagataaaccttgattttcttgttctataatggctatcttggaatcattaaatgttttttttataagatctatactcttatctttagtgccatcgttaacaataataatttcataatcatttgtttgttgatcaagtaacgaagaaatgcatttaactatatatttttcgacattataaacaggaacaattattgataatttcataatcctacttctttattttacgtttagcaacctccaattgaattttatatatcgcagctcttataaaatctttcgactcaaatcctaatatgttacttactcttttttcgatcttagaataccatggaagccatgtccctttaaaatgatgaatgcttactgtattcgaagtcaaaacaattttttcatctctgaaagttgtcttaggactaaaataatcacttgataatatagccaatgcattaccagtttccttttgtagtgcttcctctatactatatacaggttccagacgataagaatcttttaaacaaatttgttgaattataaatggtaatgttatcgtatcaagcattccatccgctttaataaatgacctgttttcataatattttaaacattcttttacccacgcagctcctttttccactccaaaagtagccatttcaagaccttgtttggaattttcaaagcatatcattgtttttagtttaagaaaaggatcaaaagatttcaaaacctcgacatccatatccatgtatataccaccataattatataacgcatatagtcgtatataatctgctgcaaaggcatatttctttttactaaatgcttctttaacccattgagatgaatggatatcaaaacgattaaaatcccaaagcatgaactcataatctggcaatttctcataccatccatcaatgaacatttgcatatctttaggaatagggtccttacttagccaacaataatgtattattttaggtatcatattaatacttttttaagcaatttgattctatcttttaaaggaaatttcacgttaaaaaataaatgaggaaagcgagttaaagcaaatgcaatccgaaacaaaatatacttccataaagaggtccatttctttaaaaataaaaaacaactaacataaggaatacagattctatctaacgttacaaccttattttttgtactacccgcttctaaatgaacgatctgtggaccattaattattgcattttttataccataagagaaatatcttctttgcatgtctgtttcttcataatataggaaataagcaggatcaaacagcccatatttttcaataatgctacggcgaataaatatatctgcccccgttacatattcaacctccatccaatcaatcggtttacctttataattgaaataacgataaaaatgagaatctaatttaaatatttcacacaaagataaatgataaaaagaactgcagacagttggaaattttccatacgatagagattcatccccttttccatcaactaacattgtacctatgcaaccaatctcaagtggcaatatccgcatcttatcataaaataattttatcgcattattcaataatagcgtatctgaattcaataaaaatataaaatctcctgttgaatattgatatccaatattattagcttgtccaaagcctacatttttctcattgtatacatactttatgcgagcgtcgtttgaaaacaaagcataactcccatccgtagaatgattatctacaagtataatttcataagaaaaaccatgagagtgttcaactatactattgatacaactctgagttacttgttttgtattataatttactataataatagaaacatccatattcttattgatatttcaattttgaattatttatgtgcaaatcacaaatatataataccattgaccaaatcataaattcaacacgagttcggtatggaaatatcatcacactaattaaaaaagttgatataatatacatttttatataaagaggtacacaatttctatatttatatactttccatagtattataggataaacagcgatataaaaaaaaccgtatataaaacattctcctataaatccgacatctgatatccaaaacccttcttttaatccccagtttactgcttctttcggacttccatttcctaagaaaaaactaataggatttgctaatatcttatcaataaaaaagaatgcactatgtattcttacattgtcattatcagtttcatctctactactttcaatcaactcctcaaaaaataaatctccccaattataaaagataacacacaaaacagccaatagacacattgtccaaattttcaatcttcgattttttaccaaaaaagctgaaagaaaaatagaaaacaatactgtaatgataatctgtcttgttagaaatagataaatgctagttaaagacaaaacaaataatattatagcccaaagtcttattttttttaacaattgtccccaacaaaaaaaaactagtaacattgcaaagcacgctgtttctattctaaatctaaacagtccattacgaatttcaattaaattatttgttgtttctgcttgtatattaattccaaaaggtgctataggaaatgtaaattgttgcactagttgaatgaacaatattattaaaactaaaattgtcaatattgcaataattatcttttcttttattccataaaaatgcaataaaaaatagtataatataaaagcatgagaacatgtatttattacattttgcatcggagattgatgatataaaaatgtattgccaattacagataaaaaagccaatttaaatatccaattaacctcacgttcaaaatttgcattaacaatttttcttttattacgaaagtataagaatataaagataagatcaaaacatcttaatatttgtccacctaatgtagggttccaatagatatacgaaaagcaggaagtagttaatacaaacaaaaaaaatgttataacataaaataaataattagatcttgtatgtaacatatttctaccgctctttacttttcttattatttatcgataaatataatatcaaaatacattttatttatcaatataatctacaactttttccattaaactcatagaaaatatcattaggtctatcagctattttttttgctgggattccggctactactgtaaaaggggctacatttttactaactacacatcctgcacaacaaacagcgccttcaccaatatgaacccctggaagtactattacattacatcctaaccaagccctatcatcaatagttacacttagatccttatcaaaatcacatccaaagtccttactcctataattatgttgtaatgtatatatggatacattagaagataaattaacattttttcctatatataatccacttcgagcatccaataaggcattatctcctattattgtcccctcacctatttttaatttataagtccctcttatctctgttctaaaatgcattattacatttttttcgatttgagcaccaagacctttgtataataaacgtcgaaaatgaacagaaggaatttctgcaatattaaacattacaaatcgactacctccatatctcaacatatattcaattacatgatatggtactgccatcattttgcacaaaacatttgttttatgatggatataaaatacattcaaggcttcacatatatacatcatagatatgaatatccatttcaaataaagtactaatactaaacaaaacaataattccaaaatcatatcactttgttttaaaagttaattgtaaagttgctaatttattaattagattataacgtaatgttctacataaatatttaattctcgtttccatatttgatgaattattattaatccaaataacaggatagaataacaaattctttttttctgcataaagccatacattcattaaacgttctgccatatatccccatatacgtttctgaattacattataatgactgatatcaattcgtttttcagcctcttttaatatagggaacaaccaattacagtaattattaaaatcatcccacttcataataaacatgttataatgaattagtttattattacgaaacattacatcctcaaaagcattgataaatttagcatcacccttttcttctataatctgttgaatgatacgcatatcactcccaatatgacaacttgcataatcataaaataatggaataggatagatcaccgaacggggaactacgataccaccttttaaaatcctgtctacaacactttggggtatggaaaaatccaataatttaaattgagaagttgtaaaagatgtaataggataaggccatttacactgcttatgaaagtcaaaatatctacgataatgacaaagtcctattacatcaacatttttcaaatttttccaagcccaatacattccagttaattcacaataactatcatttttgttacttatactatctcctgcattatcttcttgtattttcaaatctaattcaggatgtaattcctttccaacatgaattggaacatatggactatctgatgcccaaatatctagtttatgacaacatactaatattttcacattcatcgtttatatattatttaaaaggttctcctttctatgaaagatctttttatcatttttaaaattattgtgctaatagaattttttaatgctaataatatgagagtgtaaactaaacaaccagcaataatcataaccactaatgttttcatacttcctaaatagaattgtgaaagaatatacaaacagcctcccatcacaacacttcctaacacataatgcaaatgttctttcttaaaaaactgaataggaatataccttctcccaataatgaacatggaaacagtaacagctacttccgccaacatataagccactgccgtaccattatgtccataaacaggaattagtaatacattcaacaccacgttcactaccgcacctatgaatgtgcaaagaataacaatatttattctacccatcggataaagcacctgaagccccattacacccgaaatgcctaccattaaaatattcaaagctactatttgtgaagttaatatagctggagcaaaactttcaccacttaacaatagaataacactaggactagtaaatatcaatcccacagtcaagggcattgccaatgctaaaataaaatcgtatgatttctgaatcaagaccttaaattcatccatcttattttcagctatcaaattggaagtgcgtggcataattaccgctcccaaagaactagaaagactcatagttatgactagaattttagttgcagccgtaaaatatcccacagcctcagcatctttcataaaacccaataatacattgtttaattgaagataaatactaacaatgacattaaaagcaaaaatatgtatagccggttttaaatgactgaaaggatgcaacgccctaaattcaatcatatccttatgcagatattttcttaaacggacaaaattaaaaatatttcctcccagtacgcctaaaacagaataagctccataccataaaatatcctcttttgactttaccagcagaaacagtaatataacggagatggtctttactaccatcccacgaatagcaacatatttaaaatcttctattccttgataaaaccattcgcaacctatcgccgtaaaaaaaatggtggcactgagcagaagaaacaaaggtatatcggtttgcaccttagttaccgtcaaacaaatgacagcaacagccatataacccaaaagagtaagaaaggcatgtaacaataatatttcaactgtaatccgtgtcattttttccggattatcccgtactttagctacctcacgtatagcatacatcggaatacccaaacaagtgaacaagctgatataggaaataatggattgaaaaaagttcacttgtcctataccatccgccatcattatacgagaagcgtaaggaaaagtaatgagtggaaataagagttgggaagcggaatttatcagattaaatagataattcgcttttactgatttcgccattataaatatataactgttattttggcactgaatgcactagaataaggtcaagaaagcaaaagggaagcaaatgcttttcaatgtacttattgaacagagttttttataaaaaatgtaatatttaactatcacaaaaaacataaagccaaatactattccggcttctggctaaacaataaaactgtttcggtaaatactacaatgacagaggttagtctagaattatcaagacagacaataatcgctgcataattcagccttctttcaagatcccgaacaccaacgggcataaaaataattagacttatacaatgaaaatgaaagaataagaattaatatagtcaagattaagatttaccacacttcaaaataggtagcgtcctgacctgtacgtttcttaaagtcctccttcatcttcttttccagctccttaacatattcacgctttaatttccttgcttcttccaatctccgaagggcatcttcgcgtgtcatttttttagtgctttccttttccatatttccttgaatattaatattattcacatacaaagataagcaaaaatattaattatcctattccagcatttttttaactcacaacttcatccaatacttaccctatttctatttcaatgcctcagccaccggtcataatcagccaaccggccgatcagctgctgcttactctttttcggcttttcctctttcttccacggatcaatcgcctcatgcgccaaatgataatagatactgctatccgtacaaccataaagtgtaaccacagcaagtgcacgcgactgctccgccttgacgagaggaagcatagtctgcataacgccaaccaactttgccgcctcttcttccatacccaatatagtataagccggcagcaaaatggcataaagcttgcaacgcatcacatccgtatccatctggagattgccatattctttcaacgccctggcagccagagaacgatcttcctcactcaccccctccgcactgtgataacgctgaagagcactgtgcaaaccattcaacatacagtcattgtccagacgggtatatacatgcttgtcctcatcattcagggcaattacctcgtactcacccggcatcacacgcagcagcggaacccacatccagttctccacacataccatcacatcctttcgcccggctcccggctgaatgacaacagtcgcctccacccccttaaaccgtccctcggtaatgcgtatccggtcgcccttgcgcaaaccatccggctggggtatataaacaggaagtgtattggaataagaacgggccacccactgcaaattctccattgcggcatcggaaaggtaggggaaatactcccgcttccgttccctcacccgaggcaagaaactgagcacaggaaaacgttgcatcagctggaaaacatcacgctcggaggcacggacgaatacatagttgaagagtaagggacgctgggtattgacgaatttgccgtctatacgtttcacttcctgataggaaggagcaaaaaagccgaatgaaggctcgcctgcctgtatgcggcggtcctgctcccgttgcaaaccgcgcactcctccccgatggcaatcgggaagcgacaacacataccaacgcacggcattgttattccgcaaagcctccaacgcttcgggagatgccacagaacgcttcggtttatcaaactgatgggatagctttttcatgaggtttatcgtcagaaatccacgctgaccgatactggaagaccatatcagcacagtgtttataactggctgataaatagctttttacacagatttcattttgtatttctgaaatcttttatttgttgtttctttcgtccgaagacgtcttttctgtctgctttttatagacatgtttataccctcaaaaaaggttctttaccctttatataaaaggaatttagaaactttttgagggcacaaagatacactataattgtgtattacacaataaaagcgcttaaaaaataggaaaacttacttttgataagaaaataagagatgggtatattgcgtaatcacaataaaagattcaagttttacaaatatttattcaataggactgtaataaccttatccaattataaggtcattctttatagtagtaaatactatctgctcgtctacattactatattcatgcgaaataagattgcgcatatcataaatagccaaccaaggaatttccttatattcagaaagcggtgatggttgtaaaaacaacaactttcctacctgttcacctattacttgaaggcgcataacacatgcattgaacaccatcactttatccatggaggctaaaaaatcatcagcacaatttatttctttactccattgctgtatatagtaaatggattcttttatctgggttaacctgtcgcaaatggttagtcgtcctcctttatacataaatggcttctttttcaatattctgtttcaaaaatggagacagtgaggaacggaaacgcactaaatcaatttcacaatgaaacatttccgtcaaaacagtcttcaaagtgtacatagtggataaagtaggattatcaatatctacaacaatatccaaatcactatcttccctgttctcttgacgtgcaaccgaaccgaagataccaattgatttaattccaaactcatgcccaaaacattgtttgaaactaactaactttgccttacattcatttaagcataacatacttttcatcaactttaggtactggaacaaagataaaccttttatttgaacgatacaagttcttacctcggtttcttcatttcacacaccatcagagctctccctgcatcagaatgtcatcatcaccataaaccgcacgccccatttgttcgcatcgggatgatccagataattcagacggcggacatagtctatatgcaatatcttgaaaatattgtgaatacccacagagcattccatgtatggggtcttcgggtccatcacaaagctggtaggacgtccgtcacgggtcgggaacaggaagagttcgctgtcacccggatgcttcatcggattgttcttgtcggttaaatgaccatacagcatcttgaagccgatcgcctcacgccacttcagtttcttcagcaaaggaatacggttgaaaatcttaccgttcaaatcccacgatacatccagagaggcgtaacggtcgttcaggaactccatattattaatcaagttgaaagtctcgcgttgcaggatataagacaagttggccgccggcataatcagcaacgggaacggaactttattccactgcgcaccgcctttcacgaacatatcaatcttaccccatgacgagaaccagaaacgcttgtacagccctacttccgtcagattgaagttatactctccgcccagcacacccttgaaaccggtcgtgtgcgacagcgtgaataccggagcgtcaaaagaaaccggtatacggcgttgcttggtattgacaaatgtctcacccggagcgtaacggaaggccaaggaggcttccatggtctgaatctcaggaaccaacgttttctggtcatcattcgttatataggccagaccgccggtaggctcgtccgtgctgtgtttcacttccaccgtggtcttcaaaccaaactgcgtctcgttctcatacttcaaggcgatattccgcacgtaggacatctggtccaccgtagaagtcttgaaagaaacgaacacattatccttgtccgtcttcaggaacttatccgtgggcgacatcacatcatactgatagctgaacgtgatagagttcttcgggaactcgcgcggcaggtattccttcttgttgaaagagtattccacctcacccatatacttggaacgatgatccttgaacccgtaagcataatatcccttgaggaacagatgcggattcaggttggccgtggtctgcgcgctcatacgcaaacgcaatccgtcgatatagttattggagatcatggtgtttaccggaccgatatccaccttgctggggttgtccttggttccggtctccacaaagttctcgataaacgctttcaatacaaaaatcacatatttgaatcccggcatctgttccagacgcttcaccagcatatccatagaactctcggtctgcgtaagcggaaccggccggtattgattccagaaatcatctccgcgcatcatggcgtccgcctctttgatctcggcccccttacgcttgaaaagttgctgcggaagctcatcgaaggcataatcggaataacgggtagtccttcgtatctggaatccttgcatgatcttcatcaaggtcatctccacaatcatgtcatcggtcttcaacacccactcgccattgggcaattgctcgaactcctgaataatatccatattgtccacaaagttcactcccgatttcttgggcagattcatcgtacatttcttcaccgtataagatgaatcggccagtacatacagatgtcccgtgaaaccgaaatcctgcgagttattggggacaaaggtgagatggaagcacttgtccttgtccacgaatgtggtgtccataatgtaaaacttataaaacgaaatggcatcactggacgaaataggactgatgaaaggatactgcaacagacggatatcgttatcataaatattcacatccgtaaacacatccttcagaaccgtgctcagcatatctcctgtggcaaacagctcgttcacacccgtagagctcatccctttgataatggtcttctcactcttgggatgtttacggtaaattttctgcgaagcggtctcgtccaccgagataggaaggatgaatttattggtttcctcacaaagttcgatctggtctttcaggaaaggcatctttttatacatgcctttttccagcatttcgggagtcacatcattcagtgacattgtgatcttctgatacttgttgtactgataatagtcattctcactcagcttgttattgttcttatgagcaatcactttcttcatcagttccacagccgggttattcttacgggagtacttctctcgtttgggcttcaccaccacttcgtccagcatgatatcgtccggcctcatcctcacattcaggttcttggtgacaccggggattatattcactacttttgttacataccccactgccgaaaaggtgagtttattccagcctttacgggtttcgaccttataatgtccatcattatcggtaatgcttcctacgccttttccttcataaaagactgacaagtatggtatgggatcattcgtcaatgagtctgttacaacgccttgtatattttgagctgacaccgagatgcagcatcctaataacaaaaatagtaaaaacgacttgatgtattttgtcttcattctttttaccgctattcttatgagccagcaaagttaagcattaacttaaaagaaagttgctaatataagctaataattacagaaatcttacatattgaccaataaataggtgaaatttaacactgacagagcctttatatagaaaaataaaaaaggggtcttttcacaaagccccctttttaagttttcaataggtattagtttttttttaaggtaaaaagattgttttcaggataacgatgcaaatatggagcctttttttaaaccagccaaataaaaaactatgccatacaacatgtttttagaaatttctgtcttttttggcagattattattcaaaatgctctttatcggcctcattacatatacaaagatagcaaaagtttaatttgaaacagcattttaatgagttttttcttttcccaagaaatgttcgtccactttatcgcggtgtttcagtacctttgcatctataaagaaaacaatctcttcagcgatattagttatatgatctccggcacgttccagcttacggataacggtgccgagttccaggcaagtcaggaaattatcgggatgtgtttccagatattttgtaagcacggcaggggcagccgcatttatctcatccagaaagttgtccttactgaatacattgagggctaattccaaattttcttcattcaatgcgttcttggtcatttcgagcatactgagcacttgtctcaacatctcttctatacgcagactgtggagcagttcactatccagcactgtttcctcgcttcttaccacaaaacgggctatgccttcggcaaaatctcccaaacgctccaaatcactgtttattttgaacatggccagcacaaaacgcaggtcaatggctaccggattgtatagagcgatagtgtcctctacatcactgtcaattttcaactcgaacgcattcacccttttctcacggacaatgacttgctgtgcctggtcacggttaaaggtcagcacggcctctcctgccctgtccagctgattgtaaaccaatgtccacatctcgttcacttccttcttcagtgatacaagttctgattctataaatttcaccatattcttaattcttgttttgtttattattatttctttcaccgcagattgtgcagattcacactgattttaattttccggacagaagaataaaaaggcaaatccgtacccattacatctgaaaagcaaacaagcctgcatcgagctgtggtacataaattccatttttatcttatctcccattgtgcaacgctgtgatgaatgctttatccgaaacgtcccgtaatataattctgggtcgcttctttgcccggattcgtaaatatcttcttcgtatcatcatattccaccatattgcccatataaaagaaggctgttttgtcactgacacgcgcggcctgctgcatgttgtgagtgacaataacgatggtatattcttttttcagctcatgaatcaactcttctaccttggctgtagagatagggtccagtgccgaagccggttcgtccataagcagcaccgaaggagatacggccatggcacgggctatacacaaccgttgctgctgaccgccggacagagcaaacgcagactctttcaacttattcttcacctcatcccacaacgcggctcctttcaaggtttcctccaccctgtggcgaataaactcattatctttcaccccatttacccgaagcccgtaggccacattctcgaaaatgcttttcggaaacggattgggacgctggaataccattcccacattcttgcgcaactcatccacctgcacagacttgtcgtatatatttctcccgtcaatcaaaatctccccttccagacgagagccgggaatgagatcgttcatgcggttgaacaggcggaggaaggtggacttgccacaaccggacggacctatgaaagccaccacctctttctcttcaatcgtcatgcttatatctttcagtgcctgaaaatcaccatagaaaaaatttacatgttttgcatctatcttattcatattcttaatgttttaataatttgctgatttgtcaatgtactaatgtaccaatacccgtgcggtacacagcgcagccaatcggcacattgacaaattattaattcgtttttactttgttggaaaaataccggcggagtgcatttgccaacaggtttataattaaaataatgattatcagtaccaacgccgtaccgtatgccaaaggaagctgtgactccatatccgttccactggtagaaatcacataaaggtgataaggcagtgccatgcattggtccagaatgctatgcggcagttgcggcaggaagtaagcggcacacgtaaacaagataggcgccgtttcacccgacacacgtcccaaagccagaatcagtccggtaatgatgttgggcatccccatgggcagaattacatgccagatggtttgcaacttggtcgcgcccaaagccagactcccttcacggaagctgtcgggaatcgccttcaaggcttcttcggtggtacgtatcaccaaaggtacacaaagcaatcccaacgtcaaagaaccggccaggatactgtcgccgaaccccatgtatttcacaaacagtgccataccaaacaaaccgaacacaatggacggaataccgctcaagttattggtcatcatccggataaagcggaccagcttgcctttcggcgcatactcgttcatataaatgccactcatcactcccaccggaaatgcgaacagcgcactgcccaccatcagataaaaagtacctacaatggccggccatataccgccacccgtcataccgtcactgggagccgtggtcagaaactcccagctgattactcctatacctttatatataataaaaccgagaatggcgaacagaatgaggacaatgctataactcagcagtttgaaaataccgaatgccagccattgcgaacgtcttttacgcgccccttgccgggcagggaaaacatcttgcttcatattttaaatacttaattaatcatttgtcaatctatcaatatacccattggttgcgctgtgtgccgcatgatcattagcacaccggcaaattagtacattatttatttgttcttgatgaaatatattccacactaaagttgataagcatcgtgatgaaaaacaacaccactcccagcaggaacagagcttcatagtgcgcgccgccggcgggtgcctctcccagttccgctgcaatagtcgccggaatggtacgaagcggttccagaatagtggtaggtatcacagccgcatttcctgtaaccatcagcaccgccatcgtctcgcctatggcacgtccgatgcccaggacaacgcccgaagtgattccggaaatggaaaacggaatcaccaccttatatatagtctgccaacgagtggcgcccaatgccagactggcctcgcgcatggcacggggacaattccgcatcgcatcctcacttacggtaatgatagtagggagtgccatgatcgccaaaacaatacttccggccaatccggtctcgcccacaggcagattaaatactttctgaataagcggtacgataacaatcaatccgaaaaacccatagaccacggacggaataccactgagcaattcaataaccggcttcagaaaactacgggtccgatggtctgccacctcggacatatacaccgccaccgacaagccgaaaggcaaagcaaacaggatggcaaagaaactcacccaaagcgtacccgtaatcaaaggaagaaatccgaactgaggggcgggagtagccgtagggaaccattcctttccggcaaaaacctcgtcaaaagaaatagactcgtctttcagcagatgtcccggaaaatccttttctataaacttggagggaacaaaggcgatgatgcctggattaccggcaacgatctcaccgatgcaccggggagccttctcgtactcggctcccagttcttcctccgagaaataggaggtgatatcctccaaccggaaaactttaacctccgcgtccggtcctcccaactctttccagttggtaatctcttcgtcaaaaacatcttttatttgtgccgcactcagttcctgcaccggattggctttattcaccgccagtacatacccctcttctatgacttttttattaaaaagtcccagagcctccgcaaataagaatacgacaatcagcaaaatagtaatgctcgttataaagccgctgcaagtcaatatcccttctacaatcttttcccaaactcgtttcatacagttttagtcttctattttaataactgatgcaaaaaaagcctctttatattaaggtgatgtgaaagaagcttgaagtatttgctacaattatattacaaacttattacagataaagaaaagcctgatcttattaccattttcccgcaggaacagattcaatccacccttgccggcgaatattacccgtaacagaatcgtaacacaccagtaaaacaaatgacacaagaaaacgtttcttttgcacacgaattaatataagaacttatgaatcaattaaaagctctatttctttttattctattggcttgtagtctgaatattaccgcgcaacgcataaaaggtagtgacacggtgttgcccgtatcacaagaaacagccgaggttttcatgaaagatgatcccgaccgacgggtaaccgtcaccggcggaggaaccggagtggggatttccgccctgatggacaacacaacagatatcgctatggcttcccgtcccatcaaattcagcgaaaagatgaaactgaaagccgccaaacaggaagtggaggaggtaattatagcgtatgatgccctggctgtcattgtaaacccgtccaaccctgtcagccaactgacacgccagcaactggaagccatattccgcggcaagataaccaattggaaacagctggggggacccgatatgaaaatcattgtctattctcgcgaaacctcttcgggaacttacgaatttttcaaagaaagcgccctgaagaacaagaactacatgagcagcagcttgtccatgcccgccaccggagccgtgatccagtctgtaagccagaccaaaggtgctatcggctatgtgggactggcctacttgtctccccgggtgaaagccattgccgtttcctatgatgacggcaagcattatgtactgcccagccttgaaaacggaaagaagaaactttaccccgtagtacgccctctttattactattacaatgtagccaataaggaaaaagtgaccccgttcattgactacatcctgtcacccgaggggcaaaatattataaaaaacggtggatatattcctgtgaaataaaggatatcccaaaaagaatgcgtacttttgcagcaaaagtgtaaaattgatatcacaatgactgaaatgaacgctacagaagctacagagaagaaaagtctgaacttcattgaacaggcagttgagaacgacctgaaagaaggtaaaaacggagggaaagtacaaacccgctttccgcccgagccgaacggctacctgcacatcggtcatgccaaagccatctgtctggatttcgggatagctgcacgctatggtggcgtatgtaacctgcgttttgacgacaccaacccgaccaaagaagatatggaatacgtggaagccatcaaggaggacatccaatggctcggattccagtggggaaacgaatattatgcatccgactacttccagcaattatgggatttcgccgtcaatctgataaaggaaggaaaggcttatatagacgaacagaactccgaacaaatcgcggcacagaagggaactcccacccaacccggaaccgagagcccttaccgcaaccgtcccatcgaggaaagcctggaactgttcaacaaaatgaacagcggtgaaatagaagaaggcaaaatggtgctccgcgccaaaatagacatggcaagccccaacatgcacttccgtgaccctattatttatcgtgtggtaaagactccgcaccaccgcacaggcgaaacctggaaagcataccctatgtatgacttcgcacacggacagagcgactactttgaaggagtaactcattcactgtgtaccctggagttcgtaccccaccgtccgttgtacgacctgttcgtggactgggtaaaagaaggtaaagatctggacgacaaccgtcctcatcagtatgagttcaacaaactgaacttgaactacactttgatgagcaagcgtaacctgctgattctggtaaaagaacatctggtaaacggttgggacgacccccgtatgccgactctctgcggtttccgccgtcgcggctactcgcccgagtccatccgcaaatttgtagacaagataggttataccacttacgatgccctgaatgacttcgccctgctggaaagcgctgtccgcgaggacttgaacagccgtgccacccgtgtatcggcagtcatcaatccggtgaagctgatcattaccaactatcccgaaggacaggtggaggaaatggaagctgtcaacaacccggaagatccgtcggcaggcacacacaccatcgaattcagccgcgagttgtggatagaacgcgacgacttcatggaagatgccccgaagaaatatttccgtatgactccgggacaggaagtgcgtctgaaaagcggatacatcgtgaaatgtacaggctgcaagaaagacgacaacggcaacgtggtggaggtatattgcgaatacgatcccgacagcaaaacaggaatgccgggcagcaaccgcaaaatcaaaggtacgatccactgggtaagctgtgcacactgtctgcctgccgaagtacgcctgtatgaccgcctgtggaaagtggagaacccgcgtgatgagatggccgctatccgcgaagcaaagaactgcgacgcactggaagccatgaaagaaatgatcaaccccgattcgttgaatgtattaaccaactgctatgtagaaaaatatctggccgatgccaaaccgctggattacttgcagttccagcgcatcggttatttcaatgtggacaaagactctacaccagaaaatctggtgttcaaccgcaccgtatctttaaaagatacctggagcaaaattaataaataaaaacaagcttatgaactatgacatgtcttcttactttgaagacccggaatttaaagaagcattagcaagatacgagggtatggtggaaaaccatacccccgcttattttgaagctgatgaactgaccgatatcgccgaatattacgcctcaaaaggaagacataaagacgctgacaaggccataaatcttgcaatccaattgcaccctgataacatagacgccctgattttccgggcacgttccttgatgctgctaggaaaaaaagaagaagcccaaatggtgatgcagctcatcaacaaccctgccgaccgtgaattcagattcctgcaagccgacctgctgatagaggaggaacacatggaagaggccgataagatattacaacaactggccatggacgaggagtatgaactggatacgctgctagacatcattctggactacgttgacgtcaaccagaaagaatacgccaagaagtggatcgactgcctgtttgcccatttcgacatgcaaaccctgccggaaaccaaccaacgtcttcgcgacgtgctgtgcgattattacagtactttcaacaaaccggacttggctatcccttacctgaacatgactctgaacgagtttccctattccgttcagcattggaacgaactgggtaaatgctatctgcaacaagagcaatacgaaaaggcgcacgaagcttttgatttcgcattagccattgatgaaaacaacacagagacattgaccttgaaagcattcctttacagccagacagcaaatatcaaggaatctatcaactattatctccgtctggaaaaggcgacagagaagaaacctcccgtttatatggcattggctggtctccacttcgagatgaaggattacgaaaccgccatgaagtatacacaaaagctgctaaaacagaaacaggagataactgcattcgagctaaccgatatatatagtatcgcagccctctgtcatgtagccctgggacatcctgaagagggatatatgtatctggaccaagtgctgaagcagaacgggaacgatgcggaaacacgtatctatgccggacagtttttcacgataatggcaggcagcaaggacatcagcgaggaggaaagaaagaataatatcgacaaggcggaggaacaattcaacctcgccctggaattcaccccgaaagaggaacggatggatattttgttcaaaatcggatccaaatacttcgatgaacatctctttgaatatgccaaccggtattttgagcaaataaacaaagaattcccccacaacgcccatagcacttatttctttctgatttatggctatctttatttacagcaaccaggtccgttcatacactatctggctaaaatcaataaagaacttcctgatacgtatgcagctctgggagttgatgaaaacgcacagtttcccgaccagttattcaacgaagcgatacgcgtaatcaaggacgatatcagcaaaggcaagctaaacttaaacaattatttataattattttatggaatcagttgcatttattcaatggtgtctggaccacctgaattattggacaattacgttattaatggccattgagagctcttttatccccttcccctcggaagtggtagtgcctcctgccgcttacaaggcagccggaggcaacagtgacctgaatgtatttctggtagttatatttgcgacaatcggagccaatatcggcgctctcatcaattattacatagcctatttcgtaggccgtccgctggtttataaattcgcgaacagccgcttcgggcacatgtgtctgattgatgaagccaaggttcagaacgcggaacactactttgacaagcacggggcactctccacctttatcggacgtcttattcctgccgtccgccagcttatctccattcctgccggtctggccaagatgaaattatccactttcctgctgtacacaacgctgggagcaggtatctggaatgccattctggcggctatcggttactatctgcaatcagtggttcccgaagagcagttattgagtaccgtaaccgaatacagtcacgagttaggatattgcttcattgctatcggtgttttagtggtaggtttcttgatttacaaaggaagaaaataaaaaagaatgaacttttttccatttaaatttgttatcattacagtatcgaactaaaatataataaaattatggcaaaaacagcatttaaaggagcaccggtgacattggccggagaatttgtaaaagtaggaacttcagctccggaatttacattggtaaaaggagacttaagcaattatacattaaaggatggtaaaggcaagtacctgattctgaacatttttcccagtctggatacaggtgtatgcgctacttccgtacgcaagttcaatcagttggctgcaaaccagcccaatacggtagtgttggctatctctaaagacctgccattcgcccagggccgcttctgcaccaccgaagggatcagtaacgttattcctttgtctgattatcgctatacttccgattttgctgaaaaatatggtgttctgatgaccgacggtcctttggcaggattattggcacgttcggtagtagtggttgacccggaaggaaaagtggtttataccgaacttgttcccgaaataacccaggaaccggattatgaagctgcgttgaaagcagtaaaataaaaagctcccgaaggaataaagaaaacggcagaagattttgtcaatctgtctgcataggttttggtggtttcgggcataacttcaagaagttatgcccgaaacttttatgtgttatgccggaaagatctatcatcttacatacgaaagatctatcatcttgcatcttcatcttctaagacaaataccattgatacattcggtgtactccctcttctatatcaatcttatgctgccatcccagactatgcaatttgcttacatccgtcagcttgcgcatagtgccgtcgggcttcgtagcgtcaaaagtcagtttgccttgatagcccacttctttgacaatcttatccgccaattgagcgatggtgatttcttttcccgtaccgatattgatatggcagttacggatatccttggaaccgggtgtgtatgtatccttaaagtccacatgctccatgatatagacactggcatcggccatttcctcactccataagaattcacgcaacggcttgcctgtaccccataaggtcacttcctgtccggagatgccgtattttttcaatacagccagaatttcctcatccgtattcaaaccgcttactccctccacagggcggagattcatatctttacgcaccgcatcccaatctccttcattcaggcattttcccaaatgaatcttacgaatcatggcaggcagcacatggctgttctccaaatggaaattatcattgggtccgtaaaggttcgtgggcatcacggctatgtaattggttccatattgcaggttaaaactttcgcacatcttcaatcccgcaatcttcgcaatagcgtatggttcgttggtgtactccaacggtgaagtcagcaacacctcttccttcatgggttgtccggcatcacgagggtaaatgcaagtgcttcccaaaaacaagagtttctttacattgtgacggaagctctctcctatcacattctgctgaatctgcaagttctgataaataaaatcggcacggtaaagactgttcgccatgataccgcccacatgtgccgccgctaaaatgacataccggggctgctcttcatcaaagaactccttcacagcctgtccgtccagcagatccagttctttgtgagaacggcctaccagattggtatatcctttttgctgcaaattattccatatagcagaacccaccagtccgtggtgtcctgctacatatatcttggctgttttttccattattccgctatttgagcctttaaatatagtttcttcacgaacttcatatcatgcttcaccatgattttcaccagttcggggaaagaagtcttacggggattccagcccaataaggttttggctttagtgggatcacccagcaactgctccacttcggcaggacggaaatacttaggatcgacggcaaccagttccttgcccgtcgccacatcgatgcctctttcatccacccctttgccttcccagcgcaactcaatgcccacttccttgaaggccaaggtacagaactcgcgcaccgtatggtactcgccggtcgcaataacaaaatcttcgggagtatcgtgctgaagaatcatccacatacactccacataatctttggcatagccccagtcacgcaaagaatccagatttcccagatacagtttgtcctgatatccctgggctatacgtgcggcagccaaagtaatcttgcgtgttacaaagttttcaccacgacgttcgctctcatggttgaacaggatgccgttcacggcaaacataccgtaactttcacgataattcttggtaatccagaaaccatactgcttggccaccccatacggagaacggggatagaaaggagtcgtttccttctgagggacttcctgcaccagtccgaacaactcagaggtagatgcctgataaatcttggtctttttttccagacccaggatccggacagcttccaacatacgcagcgtgcctaccgcatccgcttccgcagtgtactcgggcacatcgaaacttactttcacatggctctgagcagccagattatagatttcatcgggctgtacagcctgaatgatacgtatcagcgaactactgtcggtcatatccccccaatgcaggttcaccaaacgggtcttttgcatatcacgaacccactcgtccagatagagatgttctatacgacctgtgttgaatgaagaagaacggcgcagaataccgtgaacctcatatcccttttcaatcaaaaactctgccaggaatgaaccgtcctgacctgtaatacctgaaattaaagcaacttttttcatttcgtttattgtaaatggcctcatgcaggccttctaagttatttcatatcacatagctatctaccgctatctgcctttcggcatgacaaaggacaaaatgaccaaacagaacggcagataacagacagcatacactccatgtatgcagaaataaaatatatacaagaaagaatacttactccgccgagaattctttgatgcgctgttcctcgctcaaccggcagatcaacaatgtgttattcttctcagcaacgatatatccgtccagtccctgtaccaccaccctcttttcctgtgtagtgtgaatcacacagttacgggtttcatacaactttatattctcacctatctgcgtattattatgggcatctttcggcaaattctcgtgcaacgatccccaagtacccaaatcactccatccaaagctggcaggaaggacaaaaatctcatccgccttctccataatggcataatccaccgaaatattctcgcacaaagggaaattctggttaatcatttcctgctccttgtccgtataataataaggaagcaaacgctcgaacaccttcgaaatggcaggctgatatacgcgcagggcattcaccaccgtatttacattccacacaaaaataccggcattccagaagaaattatttttttgaatatagcgccgggctgtttccagatcaggtttctctttaaaagaatacacccggaatacttccttattggcggtagaaggtacactgagatcagcttcaatgtaaccgtagcccgtctcaggacgagtaggtttcatgcccagggtaaggatagcgtccgaatcggccgtaaaattcatcgccgaattaatcacccgctgaaactccgcaatattcatcacaatgtggtcgctgggggtcaccaccatattggccttaggattacgtgcctttattttccaactgacgtatgctatacaaggagccgtattgcgacggcaaggctcacgcaagatatgatcatcagcaatatcgggcaactgctcctttacagtgtccgcatacttctctgatgtcaccacccaaatattttccggaggacagatcccctggaaacggtcagccgtaagttggatcaatgtacggccgcaacccagtacatcaataaattgcttaggataatcaggagtactcatcggccagaaacggcttccaacacctccggccattataacgaggtgattattcttgatgttcatatgattcattttttacgttgtatgaccgcaaagataagtattatttttaaaaaaaagtattgcgttttaatttatatgttctatatttgcatacgactaacattttttttgtcatgaaacaaccgacaactgaaaactctgatataattaaactagtagcgatattaggtgattttgccttgttgaacctttctatgatacttgtgttttttattctgaaaggaatagattcacaggccatagcccatatttcattgaaaacctacctgctgacttccaacctgtgctatattccatgcatatccatctttggggtcatactgcacaaccgcatagtgcgtccggaacagattgtaggccgtctgttaggaacaatcagcttgcatgtagtcatcttcctcacggtgctggccattattaaagtagataacttctcacgcatctatctgcttgttttctatctgtctttcatacctttagctataggatggcggctgacattacggttctttgtgaaaatgttccgccgcagtggcaggaacctgcacgccactgtactgataggtgacggggacaatatggtggagctataccatacgttgaacgatttgacttacggatacagggttttaggcattttctatgatgagaaggactctaattaccccaaagggattccctttaaaggtcctgtaaaccaattatttgaatggttgtctcataacaccgtgcacgaactgtactgcggtctgccatccagcagaaaggatgatattctggccatcatgaactattgcgagaacaatctaatccgcttctatagcgtacctcatgtacgtaattacataaagcgtcagctgcaactggaattattgggtgaagttcctgtattgtccatccgtaccgaaccgttgcagaacccggtaaacagactggcaaaacggttatttgatttgacattttcctctctgtttttacttacaatttttccatttatatacctatttgtaggtcttattattaaaatttcatcacctggtcccattttcttcaaacaggagagaaacggggaaaacgggaaaatttttaaatgctataagttccgttccatgaaagtgaatgcattgtccgattcattgcaggctaccaagaatgatccccgcaagaccaagttcggcaacttcctgcgaaagagcaatctggacgaactgccgcaattcattaatgttttcaaaggagaaatgtctattgtaggtcccagaccccatatgctgaaacatacagaggaatattcccaactgattaacaaatacatgatgcgccaccttgtcaaacccggaatcaccggatgggcgcaagtcaccggctatcggggagaaaccaaagaactttcccaaatggaaggcagggtaagaagagacctgtggtatattgagaactggactttcctgctcgacatccgcatcatgataaaaacagtaaccaacatgttccggggcgagaaaaacgcctattaattcaaatcgtaggaacattataaaaaataaaaagatatgaaaggtattgtactagccggaggttcgggcacgcgcctctatcctattaccaaaggagtatccaaacagttgctccctgtcttcgacaaacccatgatttattatcctatatcggtacttatgctggccggcatacgggaaatactcattatctcaaccccatacgacttaccgagcttcaaaagactgttaggagacggaagcgatttcggagtacgctttgaatatgcggaacagccttcgcccgacggactggctcaggccttcatcatcggcgagaaattcatcggaaatgattccgtctgccttgtactgggtgataacatattccacggcaacggtctgtccgccatgttgagagaatccgtacgtgctgccgaagaggacaagaaagcaacggtattcggctattgggtcagtgatcccgaaagatatggcgtagcggaattcgacaaggatggcaattgtctctctattgaagaaaaacctgcccaacctaagtccaactatgccgtggtgggactctatttctaccccaacaaggtagtggaagtggccaagaatatcaagccttcggcacggggagaactggaaatcaccaccgtaaaccagcaatttcttcaggacaaggaattgaaagtacaaacattgggcagaggtttcgcatggctggataccggtactcacgactcgctggccgaggcaagtacctacatcgaagtcattgaaaagcgccaggggctgaaagtggcgtgccttgagggcatagctttgagaaaaggctggattaccccggaaaagatgcaggaactggctcagccgatgcttaaaaaccaatacggacaatatttactgaaagttataaaagaactgggattagaataatggaagttataaaaacagcaatagacggggttttcattttggaaccccgtatttttaatgatgcaagagggtatttctttgaaagcttctcgggacgtgaatttgaagaaaaagtatgcaggactacatttgtacaggataatgagagtttctccacttatggtgtattacgcggcctgcatttccagaaacctcctttcacacaaagcaaactggtgcgtgtaatcaagggagcagtactggatgtggctgtagatatccggaaaggttctcccacttttggaaagcatgtagctgtagaattgactggagagaatcaccggcagttttttatcccccgcggattcgcacacggctttgcggtactaagtgacgaagtgttgttccaatacaaatgtgaccattattatgctccgcaaagcgaaggaggaatcgcatgggacgaccccgatctaggcatagactggcgacttccggccgacaaggttattttgtccgacaaggacaagaaacatccgagattgaaagactatcaaacggatttcgactttaatcaaagtttatattaaaggcagttttgattctgcgtttgtttggtttttgccagtgaaattaaaaaaaccgaaaactgcacacaggactatcgtaacgttcaggacaacattttcgaagattgacctataaaaacagggtgtatctcctatgagagatacaccctgtttttataggtcaatatctttatatcacttcttctccatcccctcctgaggaacattaagtcctgccttcagattttcaaagaattcacgtccgaacaagatccatgcagaagcgcccgccactgccaggaaaataaatccgacaagaatcaccttcttgctggttcccgaaggcagcaacggcacactggcaggttccacaacggcaaatacaggtttggcctcctgtactttagcccgtgccacctgcaattgggtagccacctggctatacacctgatatgccagattcatatcattctgcaatcgttctctctccgtcaaagcactttgaagaacaacccccttgttagcatccatgtaattggcataattctgctgggctacataatactcctgctggcgttccttatacaattgttccagataagcacaatcctgctgggctttagagaccctgtacgctgtgatatactcttgaagtttcaccactaccgtatctgtaatggcggccgtaaccatcgggtcctgcaaagtcaccgtcactgtggtgatgccggttttcttatccacatcagcagtaatagccttacgcatggcttccactttcttcgcctgatcttctgtcagatggaaaggatccagcttattcccttcttcctcttccttatcggagaagagagatttcaccccacctatagccgccccgggcaatcccatcacagcaccccaccacggagctttctgctcgtcgagataagctacaaaagtagtatccacctcaccgtccaacgtggtgacatgtgcattaaacagttccagaatgaaaggagtagacgctactatatccgggaaaagagatacgttcaacgcatccgcctcactgcccagactcatgccgccgatccccagcatggcagccattcccgacaggctccccccgccgcttttgccggattcgggagacaatgtcacttccaccgtatattgtttgggaatactcagagcaataatcacccctacaatagcacctattccggcagccttcaacagcacctttcgggcagcccacaacttacggacatactccatcaaatcaatttccaactcctcgtcttcccgtggcctttccttattattcgtataattcttatcttccgccatactgtttctattttaagatattagcaatagatgcaatcatagtcgccaatgacgcactggtggttgctatggacaaggtgttctgcaaagaccagttgctcttttccttcaccggaacaatcacctcacatcccggctggatcagctcacggctacctttcttcgctctcttcacctgaccgttcatatatacaatatacgccttgctcttcttcgcacggaaaccgtaacctccggcctgctcgatataatatttcaacgtcttgccatcttcaaatgaaacggtattgggatacatcacagccccactgatacgtaccgtattgttgtattcaggaatttcaatcacatccccctcacgcaatacgatatccgcactggagccgggtttaagcatcgctctttccagatcgatacccacataatagatatctcccaagtccagccggttgacatcaatggagtcctttcctgtcttggccatatccagaaccgtttccatacgtttgcgttcatcgtcattgatacgacggcttaaacgggcccctttgatataagcaaacggagtcactccacctgccttcttgatcaaatcggaaagacgttcactcttctctgtcagcgcataatcaccttcatataaaacctcaccggtcacttgcacattcacctgttcctgataagcaggactcttacgcacatatacttgatcgtacggttgcaacacaaaacccggttctccgtctatcacaaaaccgtctttcagagaaaacgagtacatttgtcctatggtggaaaccgcttccgtacctttgctatccttgatacggcgggaaacatccacacggacggtagaagccgattctttcaacccgccagcctggattataatatcctccaaagtcgtattgtcggcaaaagcgaactcacccggacgggcaacctcaccatacaccatgatagttcccacatcctccaagtcatgaatactgggaatataaagcacatcattacgctgtaaaggtacatcgggcgcagtaccggccatgataccttttatatctacttgaataacctctttcttcaaattctcacgctcgcgatgcaacactgcacgtcctgtaaaggcatcacccataagaccttcagccttttccaccagttggcggactgtattcaaagttcctccgaactgataaatgcccggacgatagacagcacccttgatttcaagtttattctcaaaacgatccagaatagcttcagcagtcagcgcatcaccatcttttacctgaaatacggaataatcaatatcatcaatcgtataaatctgatactcctttccattttgacgaatcatgcggagagaacgggtataggcatcccccgagaatccaccggcatacttcaacaatgtggcaacactttcgttgtttttcatctcgtatttcatggggcgtttcacattaccctctatgctaaccaacgcctcgtatggaggaacaatgatcacatcgccttcctgcagacggatatcatcattgattttacctttcataataaaatcgtacacatctacggtagcgatcttctgtcctccgcgcactacttgtatattacgcaaactaccgatatcgctcacaccaccggcacggtacagtgcatgaaacacggtagagaaagaagacaatgcataagttcccggttggaacacttctcccatcacattcacctggatagtccggctgtttcccaaagtaaccttgatttgtgaggacgggttctgttcattatcaagccctgcataaatcttattcagttctttacgcaaatattggttggcttcggcaatagtcataccgttcagataaattaatcccaaatcggggatcgtgatagatccgtccggagatacattatcgcggatggtagcctggtttgtaccccagatatcaatgattacctcatcacccggccccagacgataattaggaggagtagccagattcacactcggctcgaatgtaaggtttctggtttcaaaaatgtcccgtccatacaccttatccttctgcatatcttccatatcgcccatgcccatcccctcgtaataacgattggcagaaacactgtccaacgagttcttccctaccactctgtccgcagccggacgttggtcgaaagtaaaattctctgttacatagatatcttcctgagtctttgtcttttcacgcaaacggttccgattttgcatcgttgcatttgcatctttatcagcagacccattttgctgttcataaagtttctttacacgcttagcctgttcttgtgtcactcctctacgggctaactctgtagcaatctgacgttggtcttttccttgttgcatgcccgtcttcacatattccaacacctgttggtcactcatagattgctgtgcaagcacagaacccgagagggcaaaaactaagaccagtacggataatagtttttttatcatataaattcaataaacttagtaatttagcagccgcaaaggtagatattattttcgatataggcgagtattatttcataaaatatccctctaacaaatataaaaacggctgccacctgacggtgtacagccgtttattctttaatcatccgttagcagaattcattcagacttcattgcacagccctccttatttaaaaaaggtctgcaagggtaaaacttgtgcaataccgcccggccggatcagcaatacatattgacgatggcttcgtacaattcctgtttaccgcttacttgcttgggctcaccattctgcttagcataagccactacatcttccagtgtcagcttgccttcttcaaattctttacctttgccactgtcgaatgaagcataacggtctgacaacatcttgcagtaaggagattcattaagcaaagcagcagcactttccaatgcacgcgccatagcatccatacctgcaatatgggcgataaagatatcttccagatcagtagagttacgacgtgtcttggcatcgaagttggtaccgccattacccaaaccgccgttgcggataatctgcatcatggcctgggtcagttcgtaattgtcgatagggaactggtctgtatcccatccgttctgataatcgccacggttagcgtcaatagatcccaacattccgttatctaccgcaacagccagttcatgttcaaatgtatgaccagccaacgtagcatgattcacttcaatgttcaccttgaaatccttgtccagtccgtgagttttcaagaaccctaccacagtttcggtatccacatcatattgatgcttagtcggctccatcggtttgggctcaatcaggaaagtacctgtaaatcctttgctccgggcataatcgcgagcgatggtcaacatctgagccagatgttctttctcacgcttctgatctgtattcaataaagacatatacccttcacgtccaccccagaacacgtaattggagccacccagttcgatggtagcgtcaatagcgttctttatctggacagcagcgcgggcaaccacatcaaattcggggtttgtagcagcaccgttcatatagcgtgcatgaccaaaaacatttgccgtgccccataacaatttgattccggtttcagcctgtttctgtttggcataagcaactatctctttcagattcgcttcatattcctcgattgtatcggcttcctcacacaagtccacatcatggaaacaataatattcgattcccattttctgcatgaattcaaagccggcatccatcttattcttggcagcctgcaccttatcggcatcgccgttccaagggaatttctttgttccgccgccaaactggtcaccgccctcggcacacaaagtatgccaccatgccatagcaaacttcaaccagtctttcatcttcttgccgtttattaccttttcagcatcataataacggaacgccatcgggttcttactttccttaccttcaaatttaatctttcctataccgggaaaatactcttttgtagccataattctttacttattttaataacttgttctaatttatctactatcttttttcaacacgcaagcggatagccatttctttatccgaaggtccttaaaaggcagccatcgctctctccagattagatttccagcgggcatacgcatcatcataagcagtgcgctgtgccacatcaggctctatcacctccaatttttccaatgtggcaaatgcctcgttgttatctttataaacacccgcgcctatgccggcccccttggcggcgcccaccgatccatccgtgtcatacagttcgattacagcccctgtcactcccgccaatgtttcgcggaaaataggactgagaaacatattggcatgtccggcatgaatcttctgtacagggatacccatctgctccatgatatcaataccgtatttaaacgagaacacgatcccttcctgtgcggcacgaacaatatgctgctttccatgcaagttaaaattaactccacatatagagcatcctgtctctttattttccagcatacgctccgccccgttaccaaaaggaagaatacttactccggcactgccgacaggagcctgtgccgccagcctgttcatatcactgtaagaaataccttcgggagccacattacgtttcacccacgaattcaatataccggtaccattgatacacaacaacactcccagacgggtctgctcagcggtatgatttacatgggcaaaagtattcacccgggatttcggatcataatttacctcaccgttcacgccatataccactcccgatgttcctgccgtagaagcaatctctcccggattgaacacattgagcgacaaagcattattaggctggtctccggcgcgataggttacaggaattccctctttcaggcccaattctttggcagcccatgcatttacacgcccctgctcgccaaaagtcggtttgatatcagctatcagcgaacggtcgaatccataataatccatcaggaagcccgcgacatcatttgcctgaaaatcccagaacatcccttcggacaaaccggacaccgtggtacaaatatcccctgtcagtttcatagcgatataatcgccgggcagcattattttataaatacgttcgtacacagcaggctcattctctttaatccatgccagtttggaagcggtaaaatttcccggagagttcagcagatgagaaagacattgcgtttcccccaatgcctcaaacgctttctgcccgtatggaaccgcccgtgaatcacaccatataatagccggacgtaatacattttgccctttatccacacaaaccagtccgtgcatctgataagagataccgatagcggcaattccatccggaccgatcccactcccggccatgacagcctgagttgacaatttcagattttcccaccaattttgcggatcctgctcagcccatccggggcgggcagccataatagcagcctctgttttagggaagaatgcagaagagacacactttccggtttctgcatttaccaaactcgcctttaccgacgaactgccaatatcataacctaataggtacatttaaattgaaaatttaagaatttaaaaataatagtctctgtcccgatgcttatcagcattatccttccaaggaaaggccggtgaagaatcccaaagcatgtaccgattccccgaaacgaccaggcggagtattctcacagcaatcacaacaaggctaaagttatctgtctgttatcacttcgttcccgacttattatatattgaacgatcgaacttatagaagcgtgccgccctgtggcatacgcctacctgtttttcctccaaaggtactacatatggcatcaacgctatcttcttatggaagttccttacatcaaacaccttatcataaatcaactgatagacagtccgcaactgggctgccgtaaacttccggggaagcaagtcgaacattacggaaggggcatattccacataatggcgtatatgtaccaatgcatcctgcaaaatctggaaatgatcgaacgccaggcttttcacctccgtcacaggcgtccagcaagcatcgtatttatcagacagctgttcgaaccgtctgtcaatcttcaccaatgtcagataagcgatagtcacaatgcggtctattttcttctcgtccaaacgatgaaaacgttccagccacaacacatccttagggttacgggtacggtttttcgatccatacgccttaaactgtgtcagcttcacattcttcagtcccgtcagctcattcaacactcgtttggccgcctcatccagatcctcatcgtcatagataaggctacccggcaatttcatgttattatatccgtcttcggactgtttccccacctgccttaccaacaggacacggaactgctctccatcaaaaccaatcagcacacagtccacagatacatgtaaattaatcgtctggtttatttccgacatagtaatatggcttttatcatttccggcagcaaagataaatactattttttgaattatacaaaacaatatatttatttttattatgttctaaaacactatttttcaatataataaatatcatctattatacaatatgatatcttaaccttatcatatacactacaatatataatatacaggaattgtctcgtcttctttttttcctttttccaaaggacttttattccattcaatctcctatttcagacgtttggttaaaaaaaagcaatctttacgccaaaaaattaatagaataaagttgtttattcacaataattttctttacttttgcccattaaaatctaaagattactctatgagaaagaaaattttggtcttggacgacaaaatagcaattgcaaaagtcctttcaatctatctggccagtgattatgattgtatttggttaccgaatggcatcgaaggagtaaaatggcttcaggaaggtaacataccagatttgattatatcagatatccgtatgcccgaaatgcgtggagacgagtttctggaatggataaaatccaatcagctattcaaacacattccggtgattatgctaagcagcgaagacagtaccacagagcgcatccgcctgttacaagaaggcgcggaagactatattgtcaaacctttcaatcccatggagttaaaagtaagaattaagaaaattattgagtaaatcagcatgacctttctgctttatataggaaagaacaaggattttttgcgcaaattcagcaagctcgaaaatgtccagatgatttatgcccaaaactaccaggatgccattacaatttgtgtcaggctgaaagtacgtgagaacatcattgtccttcacgaacaaggggagatgaacggagatattgaacaggtcggtgcttttagaaaaaagttctatcaggcatatgtcgtactcattacggacaggctgagtcccgaagccagcaaagtctatctgaacagcggaataaacgataccgtcagtttgcacatcaccaccgcccagttaaggcagaaaatagacatcatcaataaacggcaggaactgctatatgcacataaccggaagaaaaaagacgtcaggcattttatccttccccaatggaagcgctgcttcgatattcttttctccggtacagcattagtttttctgtcaccagtctttctgctgactgccatagccatacgtctggagagcaaaggacctgttatttacaaatccaaaagggtaggaacgaattataccatttttaatttcctgaagttccgttccatgtatacggacgccgataaaaaactgaaagacctttccggtcagaaccaatacctgccggaaggtattccggagattaccgaagatttctcgatggaagaattagaagggctgatatttggagatgacggtgttatagataatggcggaatgctggtttccgatgacttcatcattccggaagaagagttcatttccaaacaaaacgcactggatgaaagtcctttcataaaaatagaaaaagacccgcgagtcaccaaagtaggacgcgttttacgaaaatacagcctggatgagctacctcaactggtcaacatattgaaaggcgatatgtctgtggtgggtaaccgtcctcttccactctatgaagccgaacgtctgacaaacgatgaaagtatcgaacgcttcatggcgcctgccgggctgaccggtttgtggcaggtagaaaagcggggggatgccggaaaattatccgctaaagaacgcaaagaattagatttgaaatacggtaaagaattctccttttttctggatatgaaaatcctgttcaagactttgacagcttttgtccaaaaaggagatgtttaaataatttgttttaggaataaaaaggggatttattatatggataaagtatgtctttttgtcatctgtatgtattgttctatccatcacttaagcgcacaacaggaagaacaacaaacacaaccggtacagcaacctcttgtgacacaagatgatatattggggaatatgaatgtggattatgcgaagataaagctgcctccgttaagtgtcctttatgagaatgcacgcagcactccaagcttacagattttagagaaagagaaactgttacagaaaaagttactatcgaaagagaaaaggaactggctggggtttatccaagccggcggaagtgcttcttacggtatagcagacaatgtggccagcaatacggatgtcaacaccccacttatttacaggtatgtaggtacagaacaaacttcgtggaacgtgggaggcggcatcagtattccttttgaaaagctgttcgacctccggggaggaatcaagcgccagcgaatccaagtggatattgccgagttaagaaaacaggaagcatacgaaactcttaaaatacaaatagctcatttatatgttcagattttatctaatatagaaacattgcaaagatcagctgaaaatatagctttatataaaggtgcatcggctgttgcagaacaggaatatagaaacagacgtacctctattcatgatgtggccaagactaaagagcaggaatttgccgctaatcaagactttgccttactacgctctactattaacgaccaactgctgacccttgaaataatctcccacacccccatcttgaccatacaaggagaaaaggacgttcaagaaacaacgatacaggaacaggaagaaaacaagaggcaaagtaagaaaaaagacaaaaaggaataagaaacatggaattatttaaatatataatcaagtttatctatcgtatccgttggtggatggttatatttccatgtatagccggtatcatagcgtggttccttaccagaagtctggaaaaaacgtatgatgtgaaaaccaccatctttacaggaatcatctccggatacaacgtagatgccaccgataccagaaatgccactgtgcacatgagtaatttaatgaatatcattacgacggaacgcacactgaaaatagtatctctgaaactgcttgcccgctgtttggtttatggagatgccgaaagaaacaccagttatatttcagccatacattaccagcagctagtttccggtattccacgagagttacaggcattgatagacaagcaaaacgaagagaaaacctatcataatctggtagcttttgaacgcccgtccatcaataattttatctaccaactactcaattatacccacccttatttcagcgtacctctactctcacaacatataaaagtagccaggttgggaaacagcgatatgatcgagattgcttatagtgccaacgatccgggaatagcttataacacacttgagatactgaatgaagaatttgtcaaacaataccatgaactacgctatggagaaacagacaatgttatcaagttctttcaagaagaactggccagattaggcaaaatgctgactgccgccgaggattctttaatcgagtacaatatagaaaaccgcatcatcaactacggagaacaaaccaaacaagtggcaagcatggacgctgcttaccggatgatggacaatgatttacttgtcaattactctaccagtaaggcgttgatcgatttctatgaatataaattaggtgatgtggccaaattgatccgtaccaacaatgagtttatggacaaacttcatcaaatgtcccaattgaacactcagatctcaaccatggaaatcactccggacgaaaagaaccggaagaaactggaggaacaaaaaaatatgttaagtaacgccgaacaaaacatcaacaatctcgccctgaaactaagtgctgaagctgcaagtacaaacaatgtatcttatgaaacactcatcagccagtggcttgaccaaatagtccttgccgaaaagactaaagcccaaatggaagcacgagatataatgagagagaatttaaatgaagatttcctttatttctcccccatcggcgccaccctgggccggaaagaaaggcatatcggctttgtggaaagcaactatatgtctaccatgggggccttaaatgcagccatcttgcgacaaaagaatctggaaatgacttcggcttcattaaaaatcatgaacccgcccctgtttccattgacctcctcccccaccaatgcacgcatgattatacttgcatccatactgggtactttacttttcatcattggttattttctgattatcgaaatactggaccgtaccctcagagacaaaatacgtacagaacgaatcaccggaggaacagttatcggcgcatatcctaaagaaagcaagttaagatacagacgttataataaagccataaacgaaatggccgtcaagcaactcagcaccgctttattgcctcatctaaatacacaggaacagcgagttatcaatttgttaagtacagaagagaaagacggaaagacccatgtcgcccgcctgatagaggaatattggagcaacatcggcttaaacgtccgccgcattacatacgatgaagattttctaagcgaagatagccaatatgtacaggcaaacaatttgaaagaactatgtcccgatctggaaaaggatgaaattcttctaatcgaacacccggtcctgaaaagcaatcctctgcctccggctttgttaaatgaagcatccatcaatctgctggttgtccgtgccaaccgtacttggaaaaatacggatcaggcactgtatgaacatttgttacaagttaaacaaaaagaagtacccctccttttctatctgacacaagcagacagaaatacagtggaagattttacaggacaattacctccttacacgaactttaagaatatggaatacaggctgtttcaactcggactgaccgccattgaatacaaaggaaaatagataatgatagcaaaagaaataaatataacccatacaggtcaaattctagccagctttattatcgggctgtgcttatgcctatggacagccctcaacatgaaacctgccataggagttgcaatagggttcataccttttgccacgctttttatttttatatgcataaacaaacccgccattctgctggccatcacctttatgctgaattacctgataatgggaattaacagatatcattccatccctattgccattaccaatatctttgacttgctctacggcatcatgttggcccttattcttctgaaacagttgcaaagcaatcatcatttcagaagaatactgaacgtctatacctgcatcacattggtctggctgctatattgtatcatcaacataggtaatggtattaccggtgaattttacatggaagcatggcttcgtattttaagaccctgggccttataccctattctgacctgtattattctatccatacactgcaatcgctacacttttatccattactttttaatactatggggtatcatgaccctactggctgccgcaaaaggatattggcaaaagaacaaaggttttgacagtaccgagctaagctggttgtgggcctacggagcacgtacccattttatccattccggtatccgctatttctcatttttcactgacgcgggtcttttcggtgccagcatgggattatcctgcactgttttcacgcttacttttttctatacaaagaacctatttctcagactcttctatttaatagtgggtatggcaggattttatggtctgttaatatcgggaacccgatcggccatagcagtacccattgcagggctggggctctttctgttcctgtctaaaagttggaaaataggcatcatctcctttatcctgcttgttggaggagtaggaatgctgaaatacaccaagatcggagagagcaataaattgatccgccgtatgcgtactgtctttgacacagaggatcaatcgatgatggctcgtttcgagaaccagaaagcactgaatgcctacatggatgaaatgcccttcggcataggcatgggagccatagacggagtagttcctccccataacaaatattatttcgtttccatctgtccttcagactccagtctggtagatgtatggaaacagatgggaatagtgggactgtgtgtgtttttgggtatgcatgccattctatttctatcgggctcctacattcttttattcaaaatccgaaatccggaaatccgaggaccgctgacaggtatgttatgcggttgtgcaggcatactggtagcttcttacgccaatatggtttatttccagtttcctaacggaatcttgatttattcctgtttcacctttgtttttttaggaccttatttagataaacaatactcagaaatacatggactaccggcagcctgacctatccgtcatcaccgtgaactataacggttttcacgacacctgcgaatttatcgactcgtggacagccactgtattctctgtcagttatgaaatgatagtcattgacaatggttccactgccaatgaagccgccttgctacaaaaaacatatccttttatccaagccgtacgcagtgagcagaacttaggattcgccggaggtaacaatctgggtataaaccttgcaaaaggaaaatacctgttcttgctgaacaatgatgtttgtatggtcaaagataccatacccttgttgataaaacgccttctgtcctccgacaagatagcaggtgtctccccgttaatccgggattatgcagaaccgcacgccatacaatttgcaggatacacccaactttcgcccattaccttaagaaacagagccataggcaaagggaaaataaataaaggccactaccccgcccaaaaaacgccttatctgcatggtgccgccatgttactgaaaaaaacaataatagacaagcttagcctgatgcccgaagaatattttctatattatgaggaactggactggtgcacctatatcaatagggaaggctacgaactatggtacgatcccgcttgcgaaatatggcacaaggacagcagctccaccggaaaagaaagtccgttgaaatactattacctgagcagaaacagattactatatgcctaccgcaatctctttgactggaaacttccggtttccattttataccagacaatgatcgtatgtcccaaaaacatactgaccgccttggggaaaggaaagaaagccatagccaaagcacattgggagggaacaaaagcatttttcaaacttagaaacaaagacaaacagccatgatatttctagcatacatagaactattacttttcgcgatatgcgcctttactgttttttacctgctggtatacgccatagcggcaacaggcaaccgcaccgacaaatattccgaatcaagagtaaaacaccgtttcgccattctgataccggcctatcaggacgatgactacataccctataccgtcaaatcatttctacaacaagaatatcctatagactgctatgacattatcgtcatttcagaccacctgaagccggaaacaaacagacagctggcacaatatcccatcaccctgttgcaagccaggttcaagaaaagttcaaaaatgaaatctgtcaaagcagctatgtcacaattacaagaaggacaatacgatatcgttttaatcatgaatgcggacaatgtagtggacaccaattttcttgaagttgtcaacaatacgtatgccagcggctccaatgccatccaaacccatcgcatctatcaagaaagacccaataatgtcagcatattgaatgccatcaccgacgagatcaataattccattcttcgtgcgggacatgtcaatttgggactttcagcttcgctgaacggctccggaaccgcaatagacttcacttggttcaaagaaaacatccgtcatttaaaagacgatgacgatgaaaaagtcatcgaatccctgctgctccgcgaacggatatatgtggaatatttaaataatacccatgtatatgccttgaagaatagtggaaagaaaaaattctatacccaacatggtacttggattaaaacccaatattattccctgttcaccaatatcggtaatctgcccggcgccattttaagtggaaaatttgattatgccgaccgtattttgcaatggttcattttccctcgcaccatcctgctaggtatcctcatcctgttcagtttcctgtccgtatacttccactggagcgcctgcctaaaatggtggggattattactcactttcttattgactatggcaatagccactccaaactacttggtggacagcaaattcaacaaagccatgaaagctatcccctttctggcggcaggcatgatattcaatatgcttttaagaaagaaaaaataaaagccccatgctatcggaaattatacatatcatggaatatacactatatatctacctttccgtcagtgtggggtatatagtcctgttttctgccgcctctcatttcttcaaacaaaagaaatatcccgcgactactgtccggcaacgctttatcatccttgttcccgcctataaagaggatgcggtcattcacgcctgcgtcacttccgttctgcgccaaacttatccggcagagctttacgacctgatagtcatatccgaccacatgcgtcccgaaaccaatgccttactgcgcaaagaacgcatcagcttgatagaactgcatgaaaaggaaagttccaaggcaaaagccctgcgcattgcagcagagaccatcacagaccagccatacgattatgtcctcatactggatgccgataatctgatctcaccctgttatcttcaagaactgaataaagcagcttcacagagtataaaagccatacagacacaccgcaaagccaaaaacatgaatacagacatagccctactggatgccgccatcgaagagatgaacaattccatcttccgcaagggacacatccggctgggattttcatctgcccttaccggctccggaatggctttcgatttccgatggtttgtccggaacatcatccatacccatagtacgggcgaagacaaagaactggaagaactcctgctccgtcaaggcattcacattgaatatatagacaccctagaaacattggacgaaaaagtccggcaaccggatgccttgcgtaaccagcgccgccgctggatagccacccagcttttccttgcattaaaaatgggacgtaacctccccacagccttactgaacggaaacggagattatctgctgaaaaccctccaagcctttatcgctccccgcagcattctgttggcgctcatcggattcttttcatgtgttctctgcattttctctccaacttcttccataaagtggtggattttgcttatcttgctgaatggtgcgttatacctggccattccgtccaatatgagatataaatacatgagcagaatcctcaggcagacaccttattttgtaatcattatgcttctcaacttgtttcacttgaaaggaatggcacagaagttcaaccatacacagcatggatagaattatgaatataaaggagtacttacaacaacacccgcaatggaaaaaacggatacacggtttcatcatgcatccggtaaagacacgcccctattggtggatacgcgtatggcaacctttctacataaaaaaaggccagggctcagtcatttatcccagtgtacggaaagaccttccaccgttccatctgttccagatgggaaaatattcggtagtggaagatttctcctgcttgaacaatgccgtaggcgacatcgtaatcggcgactattgccggataggactcagcaatacggtcatcggtcccatccggatagacaacggggtcaatatttcacaaaacgtagccctgataggattagatcacaattatcagaatatcactcaaggcatcatcgaacaaggtatcaccacttcccctatccacatcggagaacataccatcataggagccaacgtgattgtactgcccggaatcaccatcggcaaacattgttttatcggtgccgggtgtgtagttacccaaaacatacccgactattgtgtcacggtaggaaatcccgcacgcattatcaaacgctataaccctcaatcacaaacatgggagaaaatataaaaatattagtatgtgcccataaggacagccggctaccgcagcatgagtacttctgccctatacaggtgggggcctccctaaccagtgcccgattcttccctgtactagataacacaggagataatatatccgacaggaatcctcacttttgtgaactaaccgcccattattgggcttggaaaaatctaaagtgtgacattatagggctcaatcattacaggcgcttctttgattttcatcgcccttttccagctttttcaccagacaggagtttcattaacatagattcatttctaaaagaaacttatcaatttcctgatttagaaactttattaaatgattatgacatcatcctctctcccaagcgtcattatccctataacgtcgctacacaatacgccatttcccatctagtcaatgacctcaatttactgaaagaagtcattcaacacctcacacccgaatatgctgaagcttttcatacattcatgtatcactgcaatgcctattccggatataatatgttcatcaccagacggaaacattttaacgaatactcccagtggctattccgcgtattgtttgaattagaaaaacgggtaaaactgtccgcctatccggatcaggcacgtctgttcggctatttatcagaaagattgatcaatgtctattgcataaggcaccggttaaagataaagtatgttcccgtcatcatgcccttggaagaaacgtttcaaaatccgagcaacctgctttatacgcttcgccagctaaagaatgatcttatttataaactcacagaattataagttatgccgttggtttctgtcatcatccctatatacaatacagaaaaattcctgcctttgtgtatcagcagcgtcttaaaccagacactgacagacattgaggtactgctggttaatgacggaagtacggacggaagcgggaaaatatgtgacgaatacgcctgcaaggaccaacgaatacaggtaatacacactctgaaccaaggagtcagccatgcacgaaaccaaggactggaaaccgcaaaaggagaatatatagctttcatggatagcgacgactggatagaaacggatatgatagccactctttatcaacttatccggacaaacgaagccggtctggctacttgcggatatatcattgaaaatgaagatggtcgtccgatttaccacatcaacgaagtgaaatccggcaaattaacccagtgggaggccattcactccctgtttaacgacaggcattacaaatacaaaggaaacttatgggataaattatatcataaagaaatcattgacaaacatcacctaaaattcaatgaacatatttattataatgaagacagactctttatttttcaatacctgagccactgccaatcagccgcatacaccacttccccctattatcactatgtcacaagaaaatcaagcgccatgaacctgtcgcaaaaaaactacacccccaaactgtgcactttcatggatgcattcgacctgatgacttcactttcggccacattccccacctatattctacgtgctttgtcggccgattacataaaaagttcgttcttgttctatacccaacactcacgggaaatccccttcaatgaattatgggacagaatgctaagaatcagaaaaaacaattatatacatcttccactttctctaaaaataaagtatgcgctatatggcatcagacttatcctgcgggcatggctcaagtgaaaaaaacaatttactgcttacttaacacgcacccgttttatctttccatgcacccacaacaaggcacagaccaatttgtatgccatctgatgaaggccagcagttttattcagttcgggaatcagttccaataaaggggattccaccttttccagtcttatataatcctttatcattctatccggaaacaattccttatacacccgccttctttccagatctcttgtcccggcactcgtttcactgacccctccaggcacaaacctacaaacgatggaacgaatattgcggaacgtcacattgttgaatatcaaggtctgaatataaaatttccaatcggatacaatcttataattctcgtcatacctgttttcatcaaaaagttctttacgaaagaacgaagcctgatgcaatacagttccccgaatcaaatccatcagcgttatatcctccttatgaaagccccacacctctgtgccatgcactatttttccaacaacaatatcgctgtccaatgaaggtgccacctcctgcaacacaccattgttataaaattcatcaccggaattcataaagttcaaatactctccatgcgcctgtaaaactcctttattcatggcatgataaatacccttgtccggctccgatacccaatagtccactttaccggcatactcttttatcacttcaatgcttccatccgtggaccctccgtcaataataatatactcaaaatccctaaaagactggccgaccacactttctatggttttcctcaacccttctttattattataattaatagttataatcgaaaattttctttgtgacataatatttcgctttttacaatctaaagtttccattcgtcatccagactgagcgattttccgaatccgacatacagaggcacaatccggctgacattcgaagtataagtaccgataaaaaatgaagaatggatcagaatatccatatccaacagcatattcaacgtatctatatatctactttttttatcctttgtattaaacaaagactcatcaaatcctgtttgtgtcacagctgtgttacagtaaacattaaatccttcggcaactagtatggatttcaactcatccttcacagaactatcatccgtagctataaacacattacggctgatatgcttcttccctttaacagcatcaatataaagagacaaaccgagttccttcatctcacgggaaactatcttatctccccgccttatatgtaccgctatgtaatctaccggcaaattcatctcacttttcctttcttctatataaccggttgtcttttcattaaattttaatattttccgcaaggcagagccataatcatttctgatatcttccagcttctccagaaactcctccgatctcatttttagaaatacctcattccctagttccgtttccggatgaaataacagatatatcctattcattatatagaaaatataataccggaaaaaagcggacggattataatagatatttccccaccaaggcttccccttcttataaacaatatattgcgagcacatcattccgttacagtctggcaagaccgactcgaaataatcactccagcctttctccacccttgcattccagtttcttgtattgacagtcagctcttcctgattatagtccgcatagaccaatgccaatgcaagattagacaactctgagaacaaccctcttccagtcaaactatatacaattctttttttcttcatctccatagtagaacataatgatcaaacttttatatcctccaatccgataaagccgttggacgtttgtgtcagcgcatgtccgaatccactttgaaatccctcacattccagcaaacagcaacgaactgctttcaaataatattccaccataggatgatgtataaacaaatctgcctgcaggacacctttactcagcacagacggaagccctatacgcctctcgatgcaaaaatcccctttaggtaaatgactgatacttccgtaataatgtcccggagcataagtagcataaggcacttccgtcctgctcttcaaaaccagcattacatcatacatcatatcctcttcagaatatccctgtattttcacagtcagaaaattctgacctccatgaatagtggaagaggcacattccgttccgtttatctcaatgcaatctatatgaagcgtatttttcgtccaacccacataatctataattttacttttccggaccgtccctttctctttcaagtaataatcgatggcagaatgaaccgtcccctgataaactacggtaccattttccaagcatattccttttgtacacaaacttcttaccgccgccatgttatgactgacaaacaaaactgtccgtccctctcctttcgccacgtcctgcatcttgccaatggccttcttttggaattccgcatctcccactgccaacacctcgtccactaccagaatttccggctccagatgggcagcgatagcaaaacccaaccgcacggtcatacccgaagaataacgtttcactggagtatcgatatatttctccacaccggcgaaagccacaatctcatccaacttgcgggtaatctccgccttggtcatccccatgatggaaccattcatataaatattctcccgtcctgtcatttcgggatgaaagcctgtacccacttccagcaaagaggcaatacgcccccgtgcacggatacaaccggcagtaggagaagtcacccgcgaaaggattttcaacaaagtggactttcccgcaccgttcttacctataatacccagcacttcaccttcctccacatggaaattaatatctttcaacgcccatacaaaatctcccgtcgctttcttggaacggtcattctcttccccgattctgagatacgggtcctcctttccacggatccgcgcccaccaacgattcaaatcacggctcagcgtgccggttccgatgcttcccaatgcatattgcttgctgatattctgaaactctatcgctatttttcccattctgtcccttcttttaaatcacatccatgaaactacgttgcactctattaaaagtcaccatcccccaaagcattatcaccactgtaaacgccaacgtgtagcctaagtggaaccaactgaaagtccccacccccaagaatccgaatttaaatgtttcgataagggaagtcagcgggttcgccacaatgatccacatatactgctcatgactctgcctcatcacggacaaagggtaaataaccggagtggcatacatccacaactgtaccccgaaagtaatcaagaaacgcaagtcacggtacttggtcgtcaaggaggatatcaataatccgaaccccaaaccaagtcctgccaacatgagcagcagcaagggagccaaccaagcatatccgttgaccatcaacgaatatccgttgcacaaatagtaaatataaattaaaacgaacaatccgaactgaatgcccatctttatcatgcaagatataacgatggacaagggtaccaccagacgagggaaatatacttttccaaatacattctgattggcgttgaacgtatccgaacagcggcttaaacactccgagaaataattccagcaaagtaagcccgccatataaaacagcggttggggaagtccgtcggtaggaataccggcaataccgccaaaaacaaacatgaacatgacggtagtaagcagtggctggataacaaaccacaacggtcctaaaacagtctgtttataaaaagtgacgatatcccgtctgatatacattaccagcaaatccctataccgccatacctcctccagatccaaccggaacaaaccggaccgaggcttgatcacaatatcccatttttcctgttcatcttgtaccatacactactttttttagtaaattattccaactgtcacataccttctctatatgaaatgtatcagcatactccaccgccttatttcccatccattcccaatccgtccgatcagccatatacgacatacaaccggccagctgagctatattccctgtttcaaaaagaacggccatatctttgtctttcaacaactcgcgtgttatcggtaaatcagatgcaataacaggtaacccgtgcgccatagcctctatcatcaccaggccgaatccctcccaacgggaactcagcacatacatactggaatgtgcataatactcctgcacctctttcgtgaaaggatgcagcgcgatgctcttttccaattcatattcattgatcaatgaacggtaaagcgcttcctcaggaccctcccccacaatttccagtgtccagtccggatgagttttcacaaaaacagaaaaagcttttattaaaatatcaaatcctttatgtccgaatgaaaaacgaccgaccgccaaaatccttctatattccttctttccccgacctttaggcagtacagtcagaggattgtatatcacctcgcagcacaggttcattttccgaaagaaacaaccggcatctgcatgacttaaaaccaccctctcgtccaatttccccatctggacttgaaaaaagcaatccaatcccggcaaatagggagtttctttctcaaagaatgcttcataagaattatgcagccacccaacagtctttgtccggatccggctctttatagcagagaggtgcagagccataaaagcatgtaccccgatgactacatcacattgccgggcatttattttccttgccaatgtccgtttataagaagaagggaaaaaactggcagcataccatttcgaagtcagccgggtatgaggcaacccatgtttatataaaaaactatagcttttacataacaaacgctcgatgaaagaggaggtggaataagagaaagaatcaaactgcacggtactttcggcatatccgtacatcgacaagtccgtacaagtatctgtggtcagtatcgtgacttcatgttttccggacaaagccttggctatttcagccaacacacgctgtactccgccgaaactgaagacagtatcacaataaaataatattctcatggaatttagattacactctttcttcgcaaagatacgataaagaaacgaaaataaatgcggaatgaggaaagaatatcatataatacaaagcagatatatgcggcacgtacatacgcatagagcgacacgtacgtatgtgaaatcctgcacacccaaaaacaacaggtcaaataaaaaaaagaccttgttcttttttaaaaagatggcgagctttttttaaaacctcctgatctttttactgctgccggaaattcgccatattccgtagaggtatgatcccttcagacgcactttttgcaaagaaaaagcctgagaacgacctacttcatattaaaccggaacaacttataaaaaaaggatatataactgataacaaatagattatgtgaaattctgttctcaaaaacagtgagggcatgagagcataagtgagagttacaatttttaccatcactatacaaatagttcataaacaaccagttgtgcacacagtgagggcatgagggcattatcacccagaattttcagtgaaagattctcatactcatcgagatattgacaagataatgcatgatgctgaatataaatcaatatctttgcaaaaagaagaagaatgacaaagaacacaagttatcattacagcatcattattccgcacaagaatactccccgtcttctggaacgctgtctgtgctcaattcccacttgggatgaaattcaaatcattatcattgatgataacagcaattccgaatctgtcgatttttctcattttccgggaaacggcagaaaaaatacggaagtcctgttcactaaggagggaaaaggagcaggatacgcacggaacataggactctcccacgcccgtggcaaatggattatctttgcagatgcagatgatttctttacagccaattgttttactatcttaaacgaatacatggacagcccccataaagtcatctatttcaatgtacgttttgtcatgtccgatgatccgtcccaagaaagccgacgcggaacttactataccaacttcttcaatgatgtaaacccggaaaacaaactgcgataccaatctcaagttccttggggcaaaatgataaggcgcagcttcctgtcaacattccacattcaattcgatgaaacaagaatagccaacgatgtgtatttttcatgccttgtcggtatatatgcccccaaagtaaccacagacagaagaatcatttattattgtaccgaatccgaccagtcccttgctatgtccaaacaagaccgcgagagtttaatcatacggttcaacgcaagcatgaaatgcaacagactgttgcgacaagaaaaaatccactattacctgtcaccacttccgtggtgtatcccttcggcaaaaacaaaagaatggctccccgccaaatacttttttgaatacctgtttttcttccgcctgcaagcattcaaagaattatattatgctttttccgctatcctgtcacatatgaatgaaccggctacaaaagaaaccgacaaccaatgtaacaagaaaactaccaacctaaaggaataatattcattacacaagaagattcagagataccaccttccccatatcttataatacaatttgatcagattagcgtatttatacaatatgtgatgtctgtaaatcccccaattcaaaagcagagaaaaaggatagaacaaattcaattcgtacaaaacctccataggccggaactctctgcaatgcttccttatcaaatttcttttaaacttatctatcgcatcattactttcccttgtaacccctattgcagcagcattatacaccaccggcatcagcttgttcaaaatgaaacagatattttcggcatacagttcctgttccatgtgctcattaaaaacggtcaagataaaaataaaatcctttgccggcttgtcaaagtccgttttcgccctattcatggttgagaaaggatttgaacgcctgtagaaataagtaaaagaattgacggaagcaaacatttccacctttttatacagaaaatagcaccacaaaaagtcctcaaacaaaatgcccgtcctgaaataaatggcattctctgtcagcacctcctttctgatcaatctgttgaccggagtggatgttattttcgaatccagaaacagcttgttgatacgtatccgtccttccgtatatctttgcaaatcactgtttttgttttccatcccttctgaataagaatccccctgcaccaagtcaacccccggatatcttttcgtttcctcccataatttctccaggcaattctcataaagcatatcatccgaatctataaaaaaaagataaccaccccgggatagttctattcccttgttccttgccgcagagactccttcattcctctcatttctcacgattctaaaactgatgttccctttatatccggccagcttttcctctatcaggcgcatactgttatccggagagcaatcatcaatgatgatacactcaaaacaatcaaaagtttggttgattatggaatcaagacattctgatacgtatttttccaccttgtaaaccggcatcaccaccgttatctctttcatcattatctgctaatcattataaaatgcaatattcgcaaaaacaaatgatactcacaacattccaaagactttaattactaaatatacccatcttcatcccttgaaacccactctttactccgaatacagccgacattccataaaaaaacggatatggacaggaatttcaacaacttcttattggatatataaaaagaatacactatttttacggaaaaacaaatcaggggaatgaaaatagtatatgtatacgactctatagcccgtataggaggcatggagcggattttaacggataagatgaattacttgaccgaaatttatgggcacaaggtctatcttatcacttcttcccaaggcaatcatcctctttctttccctttatccgacaaagtggaacatatcgatctggatacaaagtttcatttgcaataccagcatccgcttctcgaacaattgaaagtgggatggactttgaaccataaattcgaacaaaaattaaaaaaagagatcaggctcatcaatcccgatatcatatcaggaaataccagtttcaaagcggatttgatctgtaaattagactgcaaggcaaagaaaatcattgaatcgcattgcgccaaaatatacacccggatacctgcaaaccgcaaaaagagtttttttaaagatataaaagacagatacgtcagttaccaatgtttccgtgatgtaaaacgatacagcgatgctatagtcacactgacacaaggagatgccgccatgtggggacaacatccgaatatacatatcattccgaacaccacctctattgatatacaaacaatcagctcctgtgaggctccccgtgtaatagcggcaggcagactgacctggcaaaaaggattcgacagactggttgacgcatggaatatcgtgcagaaacgccaccccgactggatactggatatatttggtgaaggattttataaggatagcttaacccggcagattaaagacagaaagctggaacactccatcacaattcatccttttacacaaaacataacgcaagaatacctgaacagttccattctggccctaagctccaattacgaaggttttggactggtcttgatcgaagccatgagtctgggtgttccttgtgtttctttcgactgtcctttcggtccatcggaaatcatcagaaaccaggaagacggactcctcgtcaaaaacggagacatacaaggatttgccaacgctctttgccacttgatagaacatgaagcagaaagaaaagcttttggcaaaagagctaaacaaaatataaaacgctactcactccgaaacatcatgccgcaatgggaaatgttgtttcataaactgactgaaaaatgaccatcgtttatctatacacagcactatgcaccgtgggaggcgcagaccggagcatcatccaaaaagcgaactatctggctgacgaaatgcatcaggatgtatttattatcacagattcacaaaaagaacgaccgcccgttttcccgatatctcccagaatcaggcacattgacatagcgattgattttgacagacagtatcatcacaacctgttagtaagagggtattattattttaccctgatgtacctgtacagaaagaagctggagtattggctgaaaaccttgaagccggatatcgtcatcagcacattgggccgagaattggattttctgacacaactggacgatggaagcgtaaaaataggagaatcccatatagctaaaccgtacactcgtaacctgcatctgatggaacaacggggattcccatacaagcaaatcgcacggcattggagaaagaaacaggaggaagctgtaaaaaaactggacgcgctggttgttctgacacaacatgatgcggataattggaaagaagtgaagaaggcttgtgtcataccaaacttcttacctttctcaccccaaaaagggagttcctgcctggaaaaaagaatcatcagcataggaagatacagcgaacagaaggggtatgaccgcctgattgaagcttggatcaaagtcaatcggaagcatcccgactggcatatccgcatttacggagaaggacaggataggaacagtctgcaagagcttattgaaaaacatcatatagaaaacagtttttcactatgccctccgacaaaaaacattcaagaaaaatatctgaaaagttccatatacgtcatgagttcacgatttgaaggattaccgatggcacttctggaagcgatggcatgtggtgttccctgcatttcattcgactgtccatacggacctgccgagattatcactccggaagaagacggaatactggtgaagaacggaaacacagacgaactggctgacgcgatatgccggctgatagaggatacggacaaacgcatacggatgggaaagcaggcccaaaagaatatccaacgttatttacgcgaagaagtgatgaaactgtgggatgaactattcaacactttaacaactacccgactatgaatatcatctatctccttttccacggactatccccttacagcggcatcagcaaaaagatcctgtatcaggttaaaggctttgaaacatgtggacaccgggtaagtttatgcacatacagcatagcggacaacggccaccgggtaaggatgataaacgatgaaataatagacgactacggaacaggcaaaccagctgcggcgaaaaggagagtttcctaccaatgcatataccgctatgctgtaacacatcaagtggaattaatctacgtacgctctttccataatgcaaatccgttcaccatccggctgttcagcaaactaaggaaagccggaattaaaatagcgatggaaatacccacctatccttacgacagcgaatacaccggttttccactgaccacacgcctggggatacaagtggataaagtattccgaaagacactggcaaaacacgtgaacgccatcgtcactttctcagactatcaccgtatattcggccaacgtaccattcagatatccaatggagttgactttgattccattccgctgaaaaagatgctttctaaaaatacctctgtcattcatctattaggagtggccgaagtacattattggcacggttacgaccgcctgatagacggtttgggtagatattaccaaaacccggcaaacacaaccgtatttttccacatcgcaggcggtatatggaaatccgaaatgcatgactcacaacacgctcccggattttatgaacttatcaacaaatatcatatagagaaatatgtcatcttccacggacaaaaaatgaatgaggaactagacgaattattcaacgaagcagactttgccatcggcagtctggcacgccaccgcagtggcatcgacaaaatcaaaacattaaaaaacagagaatatgcagcacggggaataccttttgtatattcagaaacagatggagactttgacaagatgccttatatactgaaagttccggccgatgaaagtcccatagatatccgccggcttatccggttctatatggaactggatctgtctccttgcagaataagggattccattaaaaacctgtcatggaaagaacaaatgatgaaagtaataaacaacctgtaatactcccgcctatgatccgaatcgcctattgtaccccctctctccatatccccggaggagtggaaagggtactgaccaccaaagccaattatctagcggagaatggtaattatgacatatatattttgctgactgacggaaaaggcaagcctccctgctatactttatcgcccaaagtaaaaatcatccaactgaatatagactttgaagaattatgggaacttcctctttggaaaaaagtgccggtttatctgaaaaaacaaagaatataccgacgcaagctctctgccgctttgtctcacctcaaaccggacatcacagtttctttgctacgacgggaaataaactttatcacttccctcaaagatggaagcaaaaagataggggagctacacgtaaaccggaaaaactatcgtaactttgaaaagaacgaaagcaacttcatcaaggaactttttgccaaattatggatgaaaagtctggtgaggcatttaaaaaagctggacaagttcgttgtactgagtgaggaagacagagccaactggcccgaactgcaaaatgtaaaagttatcagcaaccctctaccctttcaatccggaacattcagcgacttgaacaataaacggataaccgcagccggaagatatacttatcaaaaaggattcgatttgttactggaagcatggagcaaagtctgtaaccggcatccggactgggaattacatatatatggcaaaggagacaagactacatatcaagtactggccggaaaatggaaattaaagaacctttttcttgaaaatgcaaccccggatatgctctgtaaataccatgaaagttctatctttgtatcaagttccagatttgagggattcggaatggtcatagcggaagcaatggcgtgcggagtacctgccgtgtcattcgcctgtccgtgcggacctaaagacatcatccgggacggggaagacggactattggtcgaaaatggaaaaacagaagaactggccgaaaaaataaattatctgattgagaacgaacaaataagaaaagaaatggggaaaaaagcccgcatcaatgtacaacgttttgctgaagatgtaataatgcaacaatggattcagctattcaacaacttattaaacggaacaaaacaatgaaaacagattccccctacgacagaggagacatccatataaataaaaacgacaaagtgctggagataggtccgggccataatccgacatatcgctccaacgtgatagtcgaaaaatttattgacaccaattaccaccgctgcggtgacgtgaaaatatacccgcatcagacctttgtacatgccgatggagaaaaactgcccttcaaagacaaggagtttgactacgtaatatgcaatcaggtattggaacacgtggaacatcccgaagcttttgtcaaggaattatgcagggtagcccgacggggatacatagaaactcccagtctgctgggcgaatacttgtttcccaaaaaatcacataaatgggttatattggatatagacaacaaactggtcttctatgaaaagaacaagatgccgggaaactatgaaaacgactatggagaattattcctgaattatctgcctttccaatccctcccctacaaactgctgtggctgacggaaggagatataaccttgaaccgttatgagtggaaagatgaagtggagatactagtcaatcccgaagatgaatactactcctctttcttcctcaacaaatggaaccgggaaatggtggagaaactatatccccgccgttccgccctgacggaaatgaagaagatgattcaagccctgttctatatcctcaaaaacaaattcaaatcacgattcagtaatcaccggaatccggtcacactgtccgaatatataaaaacgcatgaagtggtacgctgactatttatccatctatgacaagcctttcacccaagccccacaagcggttatcaaccaagtgaaagacaagatccggcagcttgcaactcatgctccgctggtttcggtggtcaccatcgcccataatgaagaaaagaggatattgagctgcctgtggtctttatgtgaaaaccaacataactatcctgtagaaatactagtcatcaataatcattctaccgaccacaccgaagaggtactaaaagaattaggagtcacttacttcaatgaataccggaaaggtcccggttttgcccggcaatgcggactgaaccatgcccgggggaagtatcatctctgcatagacgccgacacactttatccgccccagtacatcagtaccatgataaaggtcttacaggacaaagaagtggcaggtgcatacgccctgtggagttttcttcctaatgaacatcatttaggacttttcttctatgaaacactacgtgatctctatttgaaaatacaaaatctgaacagaccggaactcaatgtacgtggaatggcttttgccttccacacggaaacagcccggaaagaaggattccggacagacatactccgcggagaagacggctccctggcactggcattgaaaaaatacggaaaattaagattcgtcaccgcccgcaaagcccgtgtccttaccggctatggtactgtctcggccgacggatccctgtttagcagtttcaaaaaacgagccataaaaggtttaagaagcttcacggctcttttctatagcaaaaacaattacgaggacgaagattctaacctgataaagtaacgacagatgaaaatagcaatagaagcccaacgcatcttcagaaaagaaaagcatggcatggactatgtagctctggaaaccatccgggaactgcaaaagatagacaaacaaaacgaatacttcatactggtcagcccgggggatgatatttgtttgcaggaatccgccaacgtgcatatcgtgaccgtcaactggccgtcctatccgctttgggaacagataggactgccgttggctttgagaaaaatcaaacccgacctactgcactgcacaagtaacactgcccctgtgtatggaaacattccactggtgcttacactgcacgacattatctttctagaaaaaaaacaaggcaagaaccagtccatgtaccaaagactgggacgtttctaccgaagaatcattgttccccaaattcttactagatgcaaaagaatcattaccgtttctcattttgaatgcaaccgcatcagtcatttcctgcacattgacagacaactgcttgtcgccgtacacaacggctattcacaacatttcatacccatacggaacgcacaagccaccactgcccgatacataaagaaacatccttacctgttctttttaggaaataccgatcccaagaagaatacggcaagggtattgcaggcatacggtatttatttaaaaaaatcccgtcagccccttcccttgcttatcgccgacctgaaagaagagatcatagacgaatatctgaaccggcaaggattacaagaaataaaaaaaatgctgtatcatcccggatacattccaaacacagaactacccgctgtttatagtggagcatccgtctttatatacacgtctttacgcgaaagtttcggcatccccattctggaggcgatggcctgcggaactcccgtcatcacctcaaccacttccgccatgcccgaaatcacaggaccggagggtattctggtcaatccgttcgaaccggaggaaattgcttccgccctccttcatttagaagaaaatgcggaattctatgagtcacaaactgcatatggattagaaagagtccgtcggttctcatgggagaacacagccagagaaatattgaaaatatataaagaaatactagcatgaacacccttgaaatcctcttcttcatcctcttgttcattgtattctacacctatgtgggatacggaatcctgttgtggatattggtaaaaataaaacaaagttttcttttcttctacgatacggacgaaccggagcaagaaacctgccggaacggcaacaacaccgccctgcccgaaatcaccctgttcatcaccgcctataatgaggaacaggtagtagacggaaagatgaaaaactgccacgaactggattatcccaaagagaaactgcatatcgtatgggtaacggacggcagcaatgaccgaaccaatgaaaaattaaaagcgtatcccgatgtcaccctattgttcgtccccgaaagaaaaggaaaaacagccgctatgaaccggggaatgggatttgtcaccacgcctttggtcatattcacagacgccaatacatttattaatccgcaggccgttcgcgagatagtaaaatgttttaaccatccgcaggtgggatgcgtggcaggagaaaaacgggtagacatgtacagtaccggaggagctgtttccggaggagaaggattgtactggaaatatgaatcatggctgaaaaaaatggattatcagctctattccgccataggtgctgccggagaattatttgccatccgcaccccgttatatgaggaaatgcctgaagataccctactggatgattttatgctgtccctgcgtatcgccatgaagcagtatacgatagcatattgtgatacggcatatgccttggaaagcggatcggccgatatgaaagaagaggagaaaagaaaaatacgtatctcggcaggaggattgcagtccgtctatcgtttgaaagaactgctaaatcctctacgttatggaatcctcagttttcaatatgtctcccaccgcgtactgagatggtcggtaaccccggttgccttgtttctgctctttcccctgaatatcctgctggttgtctgtagtgagagccatccggtttactttctttttcttctgctgcaatccgcattctacctcgggggagtttatggcagcttcctgtctgccaagtccgtaaagaacaaattgctttatattccctactatttcctgttcatgaacatcaatgtgataaaaggtttcttctatttgaaaagacatgccggcggaacatgggaaaaatcccgcagggcataatatttactcaccaaaatatttttctatcatctcacgcaaagcgggagccataatcggcttggccatataatcgtcacatccggcttcaaaagccttgtcacggtcactgtcatacgcattggcggtaagagctatgatgggaagtgtcccccctttcagacgaattcttctggtagcttccaaaccgtccataacaggcatctttatatccatcaaaatcatatcgggccggcaaccctcaaatttctcaatagcctcctgcccatcgtgggcacggtaaacttcatactcctttcttaaaattatagataataagaggtaattactttccgtatcttcagctaccaaaatctttttcatttcttcttttcattgattaccttgcaaaattacgatataaaatgatataaacaatattttttttgtatatttgctgtcagtaacaaatatcacgcatctaaattcgctaagagaaacagtatattgagaatcatactattaatatgaaaattccgagtaatatattgcacgataagcagtatgcagacaaaattctggaaattacggctgatactatgtttttcgtatataaagacggcacctgtttagacttcaaggctaatacgacggacttctttataaaagaacaagatattatagggagaaatatattctcttatttccctgtggaaacggcacgggagatgtatgcggaattcaccaaagtacgggcaggagacaaactttccgcacggaattacaaattaatattggaagatgacgtaaaatactacaaatgtattatcagcaagtatgatgaggagcattttctttttcaatacagggatatcacaggccggagtgtcgtcaggctgaaactggaaaaaaagcaaaaagatttgtgcgaaatagaaaaagccgcaagaataggattatgggcatacgattcgtccacacggttcttcacttattcgggatacacccggatattctgtaacgatgaggaacagaaacagatttccatagatgaatacatgaactatatgcaccttgatgacaaggcccgtttcagtcaatggctggaagaaaatctgaaggagaaggatgcttccaataccataaactacaaactccttattgacggaaagaccgtcaacatgagaataaaaacatatcataaagaggtatatatgcaaaggaccgtattggaaggatatatacagaacacatccgagattgtttggaaagcagaacgctccaaccagctgaaatctgccttccttgccaatatgagccatgaaatccgtacaccgttgaatgccattctaggattctcacgcattatagctgaaacggaaaacgccgaggaaagattgcagtattacgatattgtagaaaaaaacaacatgcgcctgcaggaacttatcaacgagattttggacctgtcgaagattgaatcgggcatgatggagttcaactatgcgcctgtatccctttatactttatgtgaggatgtaaaaaacacgtatagtttcaggtgtcagcctggggtggagcttgttttcgaagagtccgatccgtcactggttatctcgacagacaggaaccgcttgttccaggttttctccaacctgataggtaatgctacaaaattcacagccaaaggttctatcagcttcggatataaattgacggaaaaagaaattgtttttcatatagccgataccggaagcggtatttccgatgacaagatagacaagatattcgaccgtttcatcatggccaacaaccaggtgcaaggtacaggactgggtctttccatcagcaaaatcattgtagaaaagttaggaggaaaaatagctgtacaatcaaaaatggaaaccggaaccacattcacttttacattgccttacatttcagcaaacggagatatgaaatgggaggaaaaacttccaccagcttccgttaaagacaacagcagaacttcccatcaggagatgaccatcctagtggcggaagactatcaaagcaattatgacttaatagaggctatgatcggaaaaatatacaaactggtgcatgctcatgacggcatggaggctatcatattctatgaacaatacaaacccgacttgattttgatggatataaaaatgcctaacatcaatggtctggacgccaccagagccatccgggaaatgtctgccgacgtacctgtcatcgctgtaagcgcatacgcatatgaaaaagacaaaatagctgccatagaaagcggatgcaatgattttttaaccaaaccggtatctgccgacttattgaaaatgactataaacaagtatctaaaacaaaagtaatttatgggaagattagccgtatacaaatttgcctattttttatctatcctgttcacaatcttcattctgggactttccatcttcgcttatttctcaggtaaaataaatccggtagagaatatgttcgccgcgtacgttgctttaagcaaacctatactggtggttgtcaatacgatattatttacttactggctcatcagactccggtattggttatggattccattgacggggctgatggtaaactacgaatacatcacttccatgtaccaaatttataaccctaccaagtatgctaacgaaaacagactgaaaatagtgacttacaatgtccactcatttggaaatgaaatcacgggattctccgccaaagagtttgccgagatgatgaacaaggaggaaacggacgtactttgttttcaggaatatagaggtaatggcgactttacggaacaggatttacagaatacgtatgctaaaacattcccttactcgtttatccccgaaggattgagtcaggccatttacagccgctaccccatcaaacagtcacaaacaatagaatttccgaataccaataacggagccatctgggccgacctggatgtaaaaggtatgacgatacgcatcatcaacgtgcacatgcagactaccaactttgacaaaatgcgttccaaagcagcacaggctcggggagcacaagatgaggaacaggaaagagccatttatctggactattctgacaacttccgggaaaatactgtcagacgtgccggacaggctgaacaaatcagttcgctaatcaatgccacggaatatcccttgattgtatgcggtgacttcaatgaccctccgggaacttttacttatgaaacgctgaaaagcggcttgaaagacggatttcaaaccgcaggagaagggtacggagccacttaccggggggttcaccatttactacggatagactacttgttccattccaccttattggaaggtataaaatataaggtgattccttatgatatgagtgaccataacccggtatatctggaggtgggactttgataaatcacttcttcaaagctaccgagaaaaagaaagtggaacctttcccctcttcagactcaaaccataaatgcccaccattcttaacagcgaaatcctgacataacaacaagcctaatccggaaccttcctcattattcgttccgtatttgctgaaatgagtttccgtgttcaacaatttcttttgatcttcctcacccatgccttttccagtatcttttacactgactatgactttatcaccctctattccagcattaaccagaatttcggaatcattatagctgaacttgatcgcattgctgagaagattacgcaagatagtcttcatcatatccatatcggcatgtacctcaatctttccgtgcaccgggaagttcacctttatattcttcataccggctaccagattgaaaatttcgataaccgaagcaatattccccacaatatcaaagtcctgataaacgacattcagcttgcctatctggcttttagtccatttcagcaaattatccagcaaagagaaaacatcctccgtactttgattggccatgctcagcatatcaaacatttccttaccgatctgttcggacggaagactgagtatcaacatattgagcaccatcttaatggatcccatgggtgaacgcaggtcatgcgcgataacagaatataacttgtcgcgccccataataatcttacgcagttcttccgtctgctccatgatgatccgtttggcggcaaccagggatatctgatgagtaacacggatcacaagctcttccttattaaaaggtttggatataaaatcattcgcacctaccttgaaacccttcactatatcggcggtggtattcaaagctgtcagaaatataataggaatatgttgtgtttccggatcggctttcaatcgttcggcaacttcaaaaccattcatctcgggcatcatgacatccaacaaaatcaaatcggggcgggcattgaccgcctgagataatgcctcctttccattaccggcagttatcaccttaaacttctcgtttgttaacaacacttttaacaacaagacattagaaaccacatcatccacaactaaaacagtgtactcagaatgacttattacaacatttacatccgatgtcataggtatatattatttagccagaacacttttaaaataatcaatcactttcgtcagcccctcttccagatgaatgtgaggctcccaatccagcttttctcttgccagagtaatatccggcctgcgctgacgagggtcatcatgaggtaaaggttcgaaaataatgttagaatgagaacgggtcagttccagtatcttctgagccagttcaaatatggaaaattcgcaagggttaccgatattcaccggtcctgtgaaatgatcttccgtagccatcatacgcatcattccttccaccagatcatctatatactgaaaactacgcgtctgttttccgtctccataaatggttatatctttatcttgcaatgcctgtaccacaaaattggaaattacacgtccgtcatcggtcagcatattagggccatacgtattgaatatgcggattatttttaccaaaacaccatgttgacggtaataatccatgcacaaagtttcggcacaacgttttccttcatcataacaagaccggtagcctatgggattcacattcccccaatctccctccctctggggatgcgacaacggatcaccatacacctcactggtagaagcctgaagtatttttgctttgttacgcttcgccagtcccaacatattaaacgtgccgaagacagccgtcttcgccgttttgatagcatcatgctgataatgtataggagaggcgggacatgccagattgtatatctcgtccacatccgtccaaaacggattaattatatcgtgttctatcagttcaaagcgcggatgcccggtcaggtaacttatattctctttactccccgtgaaaaagttgtctaaacatataacaatattaccttcctctatcagacgagtacatagatgtgaccctataaatcctgcgcctcccgttactaggattcttttcattccccttatttttactttattttatgtttagcaaaaataattgattcccttcacttgtgcaaacatttaaaacaagattattcgttatctttgcaaatactttgtcaaaatgagatttatatgaagaaatatccttgtgtattaagtatagcaggctccgattgcagcggaggagccggtatacaggctgacctgaagacaatctccgccttgggtggttatgctgcgacagccattactgcaatcaccgtacaaaacactttgggagtacgtgccatacatcccgtaccaccggtatatgtgcgtggccagatagaagccgtaatggaagatatccgtccggatgctgttaaaataggtatgattaatgatgtggaaatagtcaagaccatagcctcctgcctccgtacataccggccccgcttcgttgtgttcgatccggtcatggtatcgaccagcggacaccggctgatagaagaggacgccatcagtgcactgacccgggaactgatgcctctggccagcctgattacacccaatctgagtgaggcggaagtattgacggaacaccgcataggctatgtggacgaaatgaaagctgccgcatcggaattattaaagttcggttgcggatccgttttactgaaaggaggacatttggagggcgacaagatgtgcgatgtattacaaatagttggagaagacaagcctcatctctttatttcagacaagatagaaagcaaaaacacacacggaacaggatgcactctttcttccgccattgctacttttctggcactgggatatgatatgccgcaggccgtagaacatgcaaaagcatatgtcaccaaaggcatccacgccgggaaagacgtgcatataggcgaaggacacggtccgctgaatcacttttacgcacctgtcccgatgaaaataatgaaataatttgtctatgcgctaattaccatgcggtacataacgcagcatattagcaaattgcctcattattattccgtagttccgaaagaaataattaactttgcaacgtttttaaaccaaaataggaaaaatatgaaagcatttgtattccccggacagggagcacagtttgtaggtatgggtaaagacctgtacgaaaactcggctttagccaaagaactttttgaaaaagcaaacgacattttaggataccgtatcacagacatcatgtttgaaggtactgacgaagacttgcgccagactaaggtaactcagcctgccgtttttctgcactcggtaatttccgctctttgcatgggtgatgatttcaaacctgaaatgactgccggacactcgctaggcgaattttccgcattggttgcagccggagcattgtctttcgaagatggtctgaaactggtttatgcacgtgctatggctatgcagaaagcttgtgaggcacaaccctctacgatggctgccatcattgcgttgcctgacgaaaaagtagaagaaatctgtgaagcgatttctaaagaaggagaagtggtagtggctgccaattataactgcccgggacaaattgtcatctcaggttctatcgaagggatcaacaaggcttgcgagcaaatgaaagctgccggtgctaaacgcgccctgccgttgaaagtgggaggcgccttccactctccgctgatgaaccccgccaaagtggaactggaagctgctatcaacgctactgaaattcatactccgaaatgcccagtatatcagaatgtggacgctttacctcacacaaatcccgctgaaatcaaggcaaatctggtggctcagctcaccgcttccgtacgctggacccagactgtgaagaatatggttgccgatggtgccgatgactttactgaatgcggaccgggtgctgtactgcaaggactgatcaagaaaattgatggatcggtcaacgcacacggtattgcttgataaataaatttcagttattataaattttatacggattaccggaatatgctgagtaatccgtatttttttatggcatttcacaaaaatattcgtaagtttgtcggtatctaaacgagatcagactatgaatgaatttaaatataacattggttatgccctgagcggaggatttataaaaggatttgcccatttggggattatgcaggctttgcatgaacatggcatcaagccggaaatactttccggagtaagtgcaggtgctcttgccgccgtcttctatgccgacggcaaagaaccttttcatattgttgaactttttgagcaccattcattcaaagaactgaccactttttctatcaacaaacaaggtctgctgaaactggacagtttcattgatttcttaaacagcaacctggagtcgaaaatgatagaagaactaaaaatccccactattattaccgctaccgatttggatcacggacgcatcgtttcttttaaaaaagggaaaatagccgaaaggctggctgcttcctgctgtatgcctatcttgtttgcccccatacgcatcaacaatacatattatgtagatggaggaatcttgatgaacctgccggtaagccccatccgcaaagaatgcgagaaagtgatagcactcaatgtagacccgctggtagcagatgaatatagcaagaatgtggtaagcatcgcactcagagcctatcattttattttccaagccaatacactgcctcaaaaagggattgcagatttgctgatcgaatcatacggactggaagaatacagcaacagggagctggaaagagccgaagagatattcgaaaaaggatacaatacggcaacggaactcctggacagattactcctggagaatggaacgatttggagataaacaaaaaaaagaataaaatggatacacaagaaaaaattattatctatcaggtattcacccgtttattcgggaacaacagcctgcgttgtaagcctaatggttctttggaggaaaacggttgcggaaaaatggccgatttcacgacaaaggctttaagcgagatcaaaacactgggtgctacacatatttggtatacaggtatcattgaacatgctacccaaaccaattatacccgctatggtatcaaacccgatcatcctgcagtagtaaaaggaaaggccggatcaccgtatgccatcaaggattattatgatgtagaccctgacttggcaaccagtatcccggaccgtatgaaagagttcgagaatctggtaaaacgaagccacaaagccggattgaaagtcatcattgattttgtccccaaccatgtagcccgccaatatggttcagacgccaagcctgaaggagtaaccgatttgggtgaaaaagatgatatgacaaaagcattcagccccaacaataatttctattatattccagatacaaaactggaaggtaatatcgacctgcaccgtggcgcagcggaaccttacatagaatttccggcaaaagcaaccggtaatgaccgttttgacgcatggcccaactccaatgactggtatgaaactgtgaaactgaattatggtatagactacatgaacggtcatagccgccacttcgaaccgattccggacacatgggtaaagatgcgtgacatcctactgttctggtctgccaaaggcattgacggattccgctgtgatatggcagaaatggttcctgtagaattctggggatgggtgattccgcaaatcaaagccgaacatccggaactgatatttatcgccgagatctataatccgggagaatacaggaattatctgttcaatggtaaattcgactatttatatgacaaagtaggtctgtatgatacgctacgcgccattacctgcggatgggaatcggcaactgctattccacaacgctggcaaagcttgggaggtatcgaaaaacgaatgctcaatttcctggagaatcatgacgagcagcgcatagcttccgattattttgccggaaacggctcgaaagccatccccgcaatgattgtatcggcttgcatgaataccaacccagtcatgatttacttcgggcaggaattgggagaacatggcatggatacggaaggtttcagcgggcgtgacggaagaactactatctttgattactggagtgtggacagcatacgccgctggcgcaacggaggcaagtttgacaataaattcctgaatgaggatgaaaagcaattgaaacaattctatacccgcctgctgaatatatgcaacagtgaaaaagccatacgggaaggtgtgttctttgacttaacctatgccaatctggccggatgggtgttcaacgaacataagcaatacgcctttttacgaaaacaggatgatgaactgatattaattatggtcaactttgactccataccggcacgttcagccgtcaatattccgcaacatgcgtttgattatttaggcatccatcgttatggagaatatgaggcaaccgaattgctgaccggaaacacagagaagctcactcttatgccggacaaaacaactcccgtattactagatggaatgaatggaaaaattctgaaattcaagctatagtttcccactacagattactcagattaacacagatacagattgaaataatcaataaatcgtatttcaatctgtgtaatctgtagtgaaaaaatattttaattctaggaaaatacaaattctttcattgtcctatctcttcaacagaccaattttcaagttcagtttaaaataatagactccgttctcacgttccagatatccatatttatctttttcagtggaacttttctcaaaccgggaattaacaaacaggaaatcggcaaagacctgacggtcagccttctgataacaaagtatctctccattaccatctacaaacagaaaaccggatatagcagaatctatcccattaaagatcttggcaggacgcattcccaaagccaaagccataagaaactgcttcatcttatattcataataactatgcttatgaatcaattcatcctttattttcaacggattgatttgtttgattgcttctatcaggtcactaactttggatatgccatccaaatgcatgacacgcaacatctcgcccaacatacggggaaaatgaagatctatcatgcaaagattactgcggaatactttatcggccacatcattatatttcaagattcctcccaaacgttctatcatcaacatacgccctgccacatcatcttcttcaccaaaagcattaattttgtttacggtaggagtagcgaatttaacacctgtctgctcgaacttcaaattggcggcacgccctccatccaacaacgggaacatagtccccaaacgggaacgaacgcaaaaacctaccaacggggcctctataccgtaaaaagcaacataaaaatcagtacggtcatccgtctttgcttccaagtcataaatggcgacttcatccaaaaattcttccacaccgtcgggagacatcacatcattctcgcgactctctttgacagcagcaaaaaccaactctgccacagccgcaaaatcctcacgaggtatctgcttatctatcttttccccacaaatacgtacggtcgcctcatcctccagaatataacggcgtgtcccgtcatgttcctcacgctgtaccatcgccacaggaaacttttgcacttcattccttttcacatcaggcgtacctgcatacacatatccgtccgctaacaagcggaaaaaggcgtaaagctcgccccactctctctttgtcgcttcaaatgccatatattttctctttttactatcgtcagctattttttaacggctgcaaagatacgcaaaagaagtcttaaaaaacaggttttcgagaaatacaaatattaaacaatgttatatagcatactttttaagtctgattatttgctattttccaaaaagtccgtatctttgcaatgtgtttttcatagtattagatttaaggttaacaaaggttggagcaaggcgttgctccttttttattttatcccccttatttttatgataaaacaagtatttcttttaatccacaaacctcgatctatcttaaatcagttctcaacaaaatccctccaataggataatcaggtagaaatttatgaagggaacacggatgtcatttatattccaattgaaccgatgaattagcatttatcaacaaatgtatcacaaatcactgcatttctataaacctgttccttatccagtttgttctaaatggcaaagacaatctttataaatgatagaatcatgaaattaaaaaaaggaagtattgcattactaacattggcaggtatgttctatatgagcgtacaaaaagcggatgcatgcacgcgtgccgtctatatcggaccggacaatatggtaataactggacgtacaatggattggaaagaagatattatgagtaatatctatgttttccccagaggaatacaacgtgcaggatataataaagaaaatgccgtgaaatggacttcaaaatacggcagcgtcattgcaacaggatatgatataggtacgtgtgacggaatgaatgaaaaaggattggttgccagtctgttatttttgccagaatccgtctttgaccgtcagggagatacacgtcctgtcatgggaatcagtatatggacacaatatgtactggacaattttgccaccgtacatgaagctgtcgaggaactgaaaaaagaatcattccgcattgatgctccccacatgcccaacggttcagcttccactcttcacctggctattacagatgaaacaggaaatacagcggttctggaatatctggacgggaatttaagcatacacgaaggaaaagaattccaagtgatgaccaattctccacgatatgattatcagttagctatcaatgattactggaaagaaataggaggattgcaaatgctgccgggtacaaaccgttccagcgaccgctttgtgcgtgcctctttttatatacatgcaatccctcagactccggacgctaaaatagctgtacccagtgtactcagtgtgatgcgtaatgtatccgtccccttcggaattaccacaccggacaaacctcatatatcttccacccgctggcgctctgtatccgatcagaagaataaaatatattattttgaatcggtcatgactcctaatctattttggttggatttgaaaaaaatcgactttagtcccaaagccggaatcaagaaactgcctctcaccaacggaaagatttatgcaggggatgccgtaaaagatttaaaagacagcgactcattcgtctttttatttcaaacccctgtgatgtaaaatagtaaaatcagtatgacgttcatgcctcatgaaaatcggttgagagcctcgtgaacgtcatacatttttacgaatgtgctccccctctggcattaagtatcttttaaaattcgttgttttataataatacaaaagcaatcatttcctctctgcttcctcattacaaaagaataatttatctttgaacggattttaatatcccatcaaaatcagaacaaaaataaaataactatggaacaaccatcactcaacgaccataataaacaggagtaccctcccatgcataccacagagcatgtcataaacaggacaatggtcaatcttttcggatgcggacgagcaatatccgcccatatagaacgcaaaaaaagcaagctggattttgcgctgcaaacatgtccggaagaaacggatattacaagaatagaaaacaccgtaaacgaagtattgcgaagaaatttgcccgttacaatggaatttatctctcaagaggaagctataggacgttttgacatgaaacgcttaccggaaaaagcttccgaaaccgtacggattgtaaaagtcggcgattacgacgaatgcctctgtataggtcaacacgtgaaaaatacgtccgaaataggtacatttaaaattataagctacgactataaagacggaatcttccgtatgcggttcaagctgatatagaacgactgtcaatctgtcccccctaaaattacaaattggcagtagtcttgacaatcaaatgtttaaagaggcttaccaacttttaatgcaaaggttttaatctttaagaaaacctttataggtttaaaagagtgcaatataaaccgcatatcatcgaactaatggtatgcggtttgcattatggatagtgaatgacaaaaccgaaaggtgaaggaattcagaaataaacaaaatgtttaaccaaaacctataggagattaagattatgatgccagtaagaagatcaaaccaaacatggttaccaagtatttttaatgatttctttgataacgactggatggtaaaagccaatgcaacagctcccgccatcaatgttattgaaagtgacaaagactacaaagtagaagtcgccgctccgggaatgaccaaagaagacttcaagattcatatcaacgaagacaacgacttggttatctctatggaaaagaaaacagaaagtactgaaggtgataaagaaggcaagaaagaaagccgttacttgcgtcgcgaattctcttattctaaatttcaacagacattgatcctgcctgatgatgtagataaagataaaattgatgcaaaagtaaacgatggtgtattaactatcgagctgccgaagcgtacgccggaagacaaagaaaaagcagctaaggttatcgaagttaaataacatgctctcaaattcagaaaagagggattgcctatgaaagggcagttcctcttttgtttttataaaagtccgtttctatttactataggttcatcgtaaccttacaacccaaagatataaatctttcacctgcaagatctataatcttccgggggtaagatctataatcttcgcattgcatcctcccttccctattctggtccatattgtcggctgtctttacgcactatacctcgctaatgtctacttaacatatttatccaacactttttccaaggcattttgtgaaatcggcttagtcagaaaatcatcgcatccggcttctatagctctgtctttgtcggactcaaaagcaaaggcagtcaaagcgacaataggcacttcttttgaataagaacgaatcaggcgcgtagcctccagcccatccatatggggcatcttgatatccatcaaaatcaagtcaggctgatgttctttaaattgattcaccgcatcctctccatccttagcccatagcagattacatctttttcctaacaatgtctttaacagcaaaaagttgctgtccacatcttccgccaccagtactgttcttctttgcaatacttttctcagtcccgtactccctgattccggacacttcgtaccccttccggattccggacattttttacccgccttataaggaattgtaaaacgaaaagtagaaccttcattcagtttggattccgcagtaatctctccacctagtttttctacaatcaccctacaaatcgcaagccccaagcctgttccctgaacaaaagtattcagtttcacgaaacgctcaaaaatcattttaatcttctcctcggagatccccatccctgtgtcttttacataaaaatcaatatactccttcctcacttcaaaaccaaaacggatttcccctttgaaagtaaattttatagcattggttatcaaatttgtaacgacttgcataattcggttctgatcttcattgattatcaagctggtgtctttattgtctaatatcaaaacaaccccagtctgcacccgatccttgtgcatctcatacacattacggcacaattctcccaagtccattggatatctgacgtattccaatgtaccggcctctatttttgccaaatcaagaatatcattgattaattgcaacaatatttccgaattctggttgataatatccgaataaagtttttcatccgccgcattatccgccatagtcatcaaacgggaaaaacctactattgcattcaaaggagtacggatttcatggctcatattggctagaaaggctgttttcagcctgtcggactgctcagccttgatacgggcctgaaccagctcttgctctatgttctgcatattagtaatatcccacgaaatgccaataataagcggtgcacgcccttccagaggaactaatgtttttaaagtctgcacgatgcgggtctcgcctgtagccgtcacatacgtttcctgcatttccatgcgctctcgggtacggatcaattccaaatcatcccgatgaaacttctccgcattctcatgctcaggaaacacttcaaaatcaatatggcccaatgccttggaagcaggaattttagagtgactggcaaatgctttgttccaataaaggtatcggaaatcatcctcagggtctttcacaaacaaataaacaggaatattattcagtatggcatccatcagataattcagttcacgcaattcgtcacggttcttgataacatccgttatatcctgtgtaaagaaccaaatcatttcctcaccctgattttgaatcataaaagccgaaacctgatgaacacgaagttttgtttctcccacacgggtatatttagcacgataagcaaaattacctccattatcacgaatctcttgaacacgtttatcaaatatttctttggtattcagagaaacaggtaaatcataaactttttgtgtgcccaactcctctttcactccatattcctcaataaactgccggttggcataaactaaggttccgtcaaccgatacagccagaatactatcactgaccttatccagtacccgtttaaatatttccaagttctgctgtgtggcaactctttcactaatatcacgacacattatcagtacatattcttcatctaaggggaaaatacgattttcataataatgaagtgtcccgtccacatccaattcatgatgggcggtagaacctctacctgtcgcaatagccttctgaagattattatgtatattgtgataagcttctttaggaaccatatcctgcatacgcatccctttaaaatcattgttggatacacccacatgattggtttcttcattagacaccacttctatacccgtttcctcatgattgaatacggtgagcatatccggcaaagaatctaatattcttaccgcatatttctccttgaaactaacgctatcaaagtttttttcagaagaagataatttttctttcagcagcctgttctcctctttcaacgattcaatttcctgctctaatgctttaagcttgtgttcacaatccatttgtattgaatatctttaggattcctaatcggacaaaattaggaaactttttgtgaacaaagaaagaatagtgaataattttctaatgaaagagaagtcactgattaatagttaatggagtgcactgttatgccgcaccccattaaccacacatcactaaacattcaaatcatttatattccgcccagctcttgatagcgatatcatccaccgtcatggtacagaaggcattgataaacgcgcttgccagacgggcattggtaatcaagggcacattcaggtcgatggcggcacgacggatcttgtacccgttatccaactctccggctgtcaggttcttcggtatattgactaccatatctatctttttccggtgcagcatatccagtgcctgaggctgcccttcctcgctgggccagtaaacacgggtattttccaccccgttttcggtcaggaagtgggatgagcctccggtggcataaagtttataacctttcttctgtaacatacgggcagcttccaaagtatccgctttctgcttggcgttaccagttgaaagcaacacactcttttccggaatacgatagcccacagacaacatcgccttcaatacggcacaagaggtatccgtaccaatgcagcctacttcaccggtagaggccatatctacgcccaataccggatcggctttctgcaaacggttgaaagagaactggctggccttaatacccacataatccaactcgaaaagattcttgttcggtttctctaccggcagtccgagcatcaccttcgtagccagttcgataaaattaattttcaacaccttgctgacaaaggggaagctgcgtgaagcacgaagattacattcaatcaccttgatatcgttatcctttgccagatattgtatattgaacggaccggagatattcaattccttggctatctgacgggagatgcgcttgatgcggcgtaccgtttccacatacagtttttgcggtgggaactggatagtagcatcccccgaatgcacaccggcatattcaatatgctcactgatagcgtatgccacgatttcgccattctgtgccacagcgtccatttccacttccttagcgtgctcaatgaactggctcaccactaccggatgctttttcgatacgtttgcagccagtttcaggaagcgttccaattcctcttgattggagcagacgttcatggccgcaccactcagcacatacgagggacgtaccaaaacagggaagcctactttatcaataaaagcatggatatcctccatagaagtcaatgcgctccattcaggctgatctacaccaatgcggtccagcatggccgagaatttatcacggtcctcggcattatcaatgctcttggcactggtaccgaggatatttacattttgcgcatccaaacggagagccaggttattgggaatctgaccgccggtagatacaatgactccgtgagggttctccagttcgaggatatccatcacacgctcaaaagtaagttcgtcaaagtaaagacgatcgcacatatcatagtcggtagaaaccgtttcggggttatagttgatcatgacactgcggtaaccctccttacggatggtctgtaaggcctgtaccccacaccagtcaaattccaccgacgaaccgatgcggtaagcgcccgaacccagtaccacaatggatttatggtcgcccaagtatttcacatcattggccacgccgctataagtcaagtacagatagttggtctgtgcaggatactcggctgccaaggtatcgatttgtttcaccaccggaagaattcccacctgcttgcgatgattacgcacatacagtataccgtcttccatatcaccctcgtagccaatggcacgggctatctggaaatcggagaatccctgcactttcgcctttcggagtaactcgtccggcatatcggtaatctgcttatggttattgccccattcgtgcatctctttagaagtgtccatgatgtgctgcaatttctgcaggaaccatttgtcaatcttggtcagctcatgaatctggtctaccgtgtaacctgcacgcatggctttgctgatcacgaagatgcgcttgtccgtcggctctcgaagggctttgtccacatcctctataaccagttccttattctctacgaagccatgcattccctggccaatcatgcgcaaacctttctgaatggcttcctcgaaagtacgtccgatggccatcacctcgcccaccgatttcatggacgagcccaactcacggtccacaccatggaacttgcccaagtcccaacggggaatcttgcacaccacatagtccagtgcaggttcgaagaatgcgctggtggtctttgtcaccgagtttttcaagtcgaacaacccgtatcccaagcctaatttggcggcaacgaaagccaacggatatccggtcgctttggaagccaatgcagacgaacgcgaaagacgggcgttgacctcaatgacacggtaatcttccgattcgggatcgaaggcatactgtacattacattcgcccacaatgccgatatggcggatgatacggatagccagttcacgaagtttatgatactccgcattggtcagtgtctgcgaaggggcgatcacgatagactcgccggtatggatacccagcgggtcaaagttctccatgttacatacagtgatgcagttatcataacggtcgcggaccacttcatattccacctctttccagcctttcaaactcttttccaccaatacctgcggcgagaaagagaaggccttttcagccagaacattcagttcctcttcattgtcacagaaaccagaacctagtccacccaatgcgtaggcggcacggataataaccggataacctaattctttagcagcgcgacgggcatcttccaagttttccaccgcttcactcttgatggtctttacattgatttcattcagtttttctacaaacaactcacggtcctccgtatccatgatggcttgtacgggagtacccaacacacggacattgtatttttcgaaaatacctgctttgtacagtgccaccccacagttcaaggcagtttgtccgccgaaagacaggagcacaccatccggacgttccttttctatcaccttttccacaaaataaggagtaacgggcaggaaataaatctggtccgccaccccttcgctggtctgcacagtagcaatgtttgggttgatcagaaccgtttcaatcccttcctccttcaaggctttcagcgcttgcgagcctgaatagtcaaactctccggcctcgccaatcttcaaggcgccggaacctaataataatactttctttatttcgtctttcatacttgttctttttaatacacggtttataacaacttcacaaattcatcaaacaggaactcggtatccgtaggtcccgacgccgcttccggatggaactgtgccgagaaccaaggtttggttttatgcctgatgccctcgttggaaccatcattcatattgatgaacagcggttcccaatcggttcccaatgtattattatctactgcataaccatggttctggctggtaatgaaacaacgttccgttcccaccatgcgcaccggctggttatgactgcgatgaccgtatttcaatttatagatagtagcacctcctgcttttgaaagcaactgattccccatacaaatgccaaagataggcttgtcgctcaagctcatcgccttgcggatatgctgtaccgcctcatcacatgtatccggatcacccgggccgttcgaaataaacaatccgtcatactccatccctgtaaaatcatggttccaaggaacgcggatcacttccacatcccgtttcagcagacagcggatgatatttgtctttacaccacaatccaccaacaccactttcttcttgccggcgccttcgttgtaacgaatcacttccttgcatgatactttatccacatagttgatacctgcatacgttgcttcgggcactttatcgggctcatcatcaaatacgatcttccccatcatcaccccatgttcgcgaagaacttttgtcagttcacgggtatcgatacctgtaatgcccggcacttgctcacgcttcagccagtcggccagactttctttcgcattccagtgactgaattcttcactgtaatcacttacaataatcgcttcggcatggatacgttcactttccataaaagtggccaagccgttgggttcgatagtaaagggaggcaccccgtagttaccgaccaacgggtaagtcaaggtcatcaactgccccgcgtatgaagggtctgtcaagctctcaggataaccggtcatagcggtattaaacaccacttcaccggctaccggtttctcataaccgaacgacttgcccgggaaacggctcccgtcgtcgaggatcaatgttacatttctcatctaatctatcttgaatgttattctttagaattgatatactttttctatataatctataaacgcctggttcaccagcttcactccacccggagtaggataatccccactgaaataccagtcgcccgtatggttgggacatgcttcatgcaatccttccaatgtctgataaacaatctccactttagcttgcgtacctttcggagtgagaagttccaccatttttgccgcaatctcctcattagtgaaaggagcgtaaatttctttcacataattcaccatctgctctttgggtaaccccacctggtctttcgatttgttgtaagcacgggctattacatctttcatatctcgttctttcaataaatcgatagcagccttgaaagcgataaactgatccatgctggccatatcaataccataatagtccggataacgcacctgtggagaagaagaaacaatgacgattttcttcggatgcagacgatcaagaataccgataatgctttgtttcaatgtagttccccggacgatgctgtcatcaataataaccagattatccacatgaggtatcaaactaccgtaagtaatatcgtacacatgggcggccaagtcattccggctgttgccttcggcgataaaggtacgcagcttgatatccttgatggccactttttcgctacggatacgccaggacaggattttttccagttcctcgtgattgggatgatgtcccaaagcctctatcttctttactttcagttcattcagataattgtcgaatccttccagcagtccatagaaagccacttccgccgtattgggtataaaagagaatacagtatgctccacatcatagtctaccgctttcaagataggattcaccagtttttcacccagcagctttctttctttataaatatccatgtcgcttccccggctgaaatagattcgctcgaaagaacaagctttcttctctttcgcccggttgatctgtgccagacgcatctttccggtcttgctcatcaatatagcctgtcccggttgcaattcattgatgcttccggcaggcacattcaaagcagtctgaatgacgggacgttcggacgccaataccatgatttcatcgtccatgtaccagaaagccggacggatgccccacggatcgcgtaccgcaaaagattcaccgctaccggtcataccgcagatcacatagcctccatcccactccttgctcgaagtcttgaggacattgcccaagtcaatgcggtcttctatggcgtgagtgatattcatacccttcagaccttccttctcacattccacatagaggcgctccacctcacgatccaaacggtgtcccacttgttccaacataatatatgtgtcggcatatttacgcggatgctggccgtcagcagtgatacgtgcgaaaatctcatccacattggtcatgttgaaattgccgcacagtgccagattcttggcacgccaattgttacgacgcaagaacggatgcacgtaggagataccactttttccggtagtagaataacgcaaatgacccatgtacacctctccggcaaagggaaggcatttcttggcgtatccggcatcatgcaattgttcgggcgccaaatccttgaaatgattttgcaccgtaccgaatatctctgttatcgcccctgaacctaaagctctttcacggaacatatattcttcaccgggattggcctccagtttgacacaggccagcccggcgccttcctgtccgcggttatgttgtttttccatcagcagatacagcttgttcaagccatacatccaggttccatacttttcctgataatattccagcggtttcagcagtcgtatcatagcgaccccacattcatgctttaacggttccatgctctctctttactccttaaattaatatatcattttcagattcttataaaaacatcccaaaggtatgacaagaccttctgtcgtttttccaaacttacggcacatctttcaagaattatgccggaaacttccgggaacttcctgcataatctccggcagcattgccttctattctactgttaccgacttcgccagatttcgtggctgatccacatttttccctttgcaaatggctacatggtaggccaataactgtaaggggatcgtagctatcaacggttcgaggcactctaatgtttcgggcaactcaatgcaatcatcagccaacttgctgattaccgtatctccttctgtgaccaaagcgattacttttcccttccgcgctttaatttcctgtatgttactcattatcttttcatacatcgcattatgcgtagctaccacaacaacaggcatttcggcatcaatcaatgcgataggtccatgtttcatctcagctgcaggataaccttcagcgtgaatataagatatctccttcaactttaacgcaccttccaaagctaccggaaaactgtaacctcgtcccaaatagaggaaattatgtgcataggtgaagatacgcgacagttccgctatcttgggattactgatcagaatcttttttattttagccggaatcacagtcaattcccgaatcacttccaggtatttctcatccgtcatgctccctttctcttttgccagggtcagcgccagcatggtcagcacagttacctgtccggtaaatgccttagtagacgccactcctatttccggtcctacatgaatataagaaccggtatctgtaatgcgcggaatggatgaacctaccgcattgcatataccataaataaaagctcctttctctttcgccagttctatggcagccaatgtatcggccgtctcgcccgattgcgagatagctattaccacatcatcttcatgaatcaccggatcacgatagcggaactcggaggcatattccacttctaccggaatacggcagaaactttctatcagttgtttccctatcaatccggcatgccacgaagttccgcaagccacaattacaaagcgacgagccttgagcagacgttccttatgatcaataaccgccgacagtactactttatcaccgtccgcattgatgcgtccacgcatacagtcgttaatacaatcgggttgttcgaatatctccttcaacatgaaatgcgggtatcctcctttctccagctgtcccagattcatttccaccgtacgtacttcgggattttgaagcacgttatccaaattgacgacttccagcgccttgtctctgcgaatcaccgctatctccccatcttgcagatacaccactttatccgtatactctacaatcggagtagcatccgaggccaaaaaaaattcatccttccctatccctaccaccagcggactgcttttacgggctgtaataatctcatcgggattattcttgtcaagcaccgctatggcgtatgcaccaatcacctcatgcagagccaactgaacggcagtaagtaaatctaaatggttggaaagctggaaaaattcaattagctggacaagaacttcggtatctgtactacttttaaagatgaacccttttttttgtagtttttctttcagggtagcgtagttttcaataataccattgtggataagagcaagattctcggaagaagaaaaatgaggatgggcgttagcctggcaaggctctccgtgagtagcccatcgggtgtgggcaataccaattgtaccggaaacgtctttttgggaaacaaaagcttctaggtctgagacctttcctttcgtcttatagacgttcaacctcctttttttatcaatcaatgcgactcctgcgctatcatagccccggtattccaaccgcttcaggccttttatgaggacagggtaagcatctcgttttccaatgtagcctactattccacacataatttatataagtatatgttctgatttggctgcaaagatacaaatatcaattaacataaatgcaataaaagaccataaataattgacgaaagcgataaaaaagtaagaatagaaatcgaaaagaaatgttttatccgtttttaaaataaatatgaaaacttacattatcaaagcaatttcgccaaatcatgttacgatttaaaagtaatagacaggcagaataaacaatatgtaagcatcaaaagcagaagagcatctttttactaacacagctcatttattttatagcaaaaagaaataaattatctacctttgcaaaacaaactgaaatacaaatcaacattattacaaactaaagacagtcataatggtaaaaagagaacaaaatggtctttataatgcaaccaacgaacatgatgcttgtggtgtaggtatggtagtcaacattcatggcaataaatcacatgaactggtagactccgcattaaaggtactggagaacatgcgccatcgaggtgcggaaggagctgacaacaagaccggcgacggcgcgggaattatgctacaaatcccccacgaattcatcctcttgcaaggtatccccgtacccgagaagggaaaatacggaaccggactaatatttctgccaaaagatgaaaaagaacaagccggtatcctaagtattatgattgaagaaatagaacgggaaggactgacactgatgcatctgcgcaatgtgcccactaatcccaattgcttgggcaaagacgcacgagccaccgaaccggatatcaaacaggtgttcatcaccggagtgactgatgtggaaaacttggaacgtaccctttatgttatccgtaaaaagattgaaaaacgtgtccggcataaagatttctatatcgtttcactatcgggcaaaaacattatatataaagggatgctttcgtccatgcaggtacgcgagtacttcccggacttaacacaaccttactttaccagtggactggcattggtacactcccgcttcagcaccaacacatttcctacatggagtctggcacagcctttccgtctgttggcgcataatggtgaaatcaataccatccgcggcaaccgaggatggatggaagcacgcgaaagtgtcctctcctctccggcattggggaatatcaaagccatccgccccattattcagccaggtatgagcgacagtgcctcactggacaatgtgcttgaattttttgtgatgtcgggattgagtctgccccatgccatggcgatgctggttcccgaatcattcaatgataaaaatcctatcagtgaagagttgaaagcgttttacgaatatcactccatcctaatggaaccttgggacggacctgccgcgttgctgttcagtgacggacgctttgccggaggaatgttggaccgcaacggcctccgccctgcccgttacctcatcaccaacaatgacatgatggtagtggccagcgaagtaggcgtgatggatttcgaaccgggagagattaaagaaaaaggacgtctgcaaccgggaaaaatactgatgattgacactgaacagggtaaaatatattatgacggagaactgaaagaacaattggcatcagcccgtccttatcgcacctggctgtctaccaaccgcatcgaactcgataccttgaaaagcgggcgcaagatagacaaccggatagccggttatgaccgtatgttacgcaccttcggcttctcgcgtgaagatatagaacgtaccctcataccaatgtgtaacacaggggccgaacctgtcgcctctatgggtaacgacacgccgctggcagttctctcggacaaaccgcagttactgttcaactacttccgccaacaattcgcacaggttaccaatccggctatcgaccctatccgtgaagaattagtcatgtcgctcaccgaatacatcggcgccgtaggaatgaacattttagtacccagcgaaagccattgcaaaatggtacgtctgccccatcccgtactaaataacacccaactggacattctctgcaatatccgatataaaggattcaataccgtgaaactccccatcctattcgaggtgagcaaaggaaaagccggactacaggaagcgctgagtaatttgtgcaaacaggccgagcaatccgtgaccgacggagtaaactatatcattctaagcgaccgttctgttgatgcggctcatgccgccatcccgtcactgctggcggtaagcgctgttcatcatcacctcatctcggttcagaaacgcgtacaaaccgcattgattgtagaaagcggcgagattcgcgaagtgatgcacgccgccctgttactgggatatggtgccagtgccatcaatccgtacatggcctttgccgtactggatgaactagtgagaaaaggcgatgtgcagatgaattatgaaacggccgaaaagaattatatcaaagccatctgcaagggcttgtttaaaatcatgagcaagatgggtatctctacgatccgttcctatcggggcgcgaagatttttgaagccgtaggggtcagtgaggaattattgagaagctatttcggcacacagacatccagcatcggaggtattcgtctggaagaagtcgccaaagatgccatcgccctgcacgatgccggattctctccgaaagaagtgagcgacattttaccgcataacggactgttctctttccgcaaagacggagaacggcacgcctggaatccggaaaccatctccaccctgcaactggccacccggctgggcagctacaagaagttcaaggaattcacctccatggtagatggaaaagagtcacccctcttcctgcgcgacttcttcggacacaaacgaaactccattgatattgaaaaggtggagccggtagaaaacatcgtgaaacatttcgtgacaggagccatgtccttcggcgctatcagcaaggaggcacatgaggcgctggcactggccatgaacaaactgggcgcacgcagcaatacgggtgaaggaggtgaggacagcgaccgcattaccggcacttaccagggtatctcactttgcagcaagaccaagcagatagcatcgggacgcttcggagtcaccgccgaatacctggtccatgccgaagagatccagataaaggtggcccaaggcgccaagccgggagaaggaggacaactgccgggattcaaggtagatgaggtgattgccaaaacccgccactccattccgggcatctcgctcatttcccctccaccccaccatgacatttattccatcgaagatttggcccagttgatattcgacctgaaaaacgtaaacccacaggcacgaatcagtgtgaaactggtagccgaaagcggggtgggaaccatcgccgccggcgtggccaaagcgaaagccgatctgattgtcatctcgggagctgaaggaggaaccggagcgtcacctgcctcaagtatgcggtatgcaggtatctcgcccgaaataggactgagcgagacgcaacagactttggtgttgaacggactccgcggacaagtgaaactgcaagtggacggacagttgaaaaccggacgggatattatcaacatggccttgctgggtgcggaagaattcggtttcggtaccaccgcattgattgtactgggatgcgtcatgatgcgcaagtgccacaccaacacctgtcccgtaggcgtggccacccaagaccccgaactccgcaaacatttccgtgggcattataaatatgtagtgaattatttcactttcctggcacaggaagtacgcgaatatttggccgaaatgggattcacccggttggaggatatcattggacggacagacctgattgaaatacaacaagcgccaagtgagaagaaatcctcactattggatttcagcagactgctacaccgggtggacaacggagctgccatacaccatgtcatggaacagaagcacgacattgcccatgtgaaggatgtgaccatactggccgccgccagggatgccatagaaaacggaaaagaaatttccctggaatacaccatcgccaatacggaccgttcggtaggcgccatgctggcaggagcggttgccaagaaatacgggcaggcaggacttccggaacagaccatccacatcaaattcaaaggttcggcaggccaaagtttcggtgcgttcctgacccacggcatcagtttcaagctggaaggcgaagcgaatgactatctgggaaaaggactgagcggcggacgcattgcggtactgccccccgtgcgcagcaatttcgatgcggaaaagaataccatcgccggaaacaccctgctgtatggcgctactgacggcgaggtgtatatcaacggacgagtgggtgaacgcttcgcagtccgcaattccggagtgacagccgtggtagaaggtgtaggcgaccactgttgcgaatatatgactggaggacgagttgtggtactgggagaaaccggacggaatttcgctgccgggatgagtggcggtgtggcttatgtatgggacaaaaaccacaacttcgattatttctgcaacatggaaatggtggagctctcgcttatcgaggaggcatcttaccggaaggaactgcatgaactgatccgccagcattacctctataccggctccaaactggcacgaacgatgttggacaactggaaccgctatgtagatgaatttatccaggtagtccccatcgaatacaaacgagtattgcaagaagaacaaatgcgcaagctgcaacaaaaaatagctgatgtacaaagagattattaatacatcacacaaattatcaacaaagaaatacaacaaaaatatgggaaatccaaaagcatttttaaccattccgcgccaagaagcgggctaccgtcccattcacgaccggatatcagactatagtgaggtggaacagaccctgaacagccgtgaccggaaacttcaagcttcacgctgcatggactgcggtgttcctttctgccactgggcttgtccgttgggcaacaagcaacccgaatttcaggacgccctctacaaaggcaaatgggaagaagcctacaagatattgaacgaaaccaacgattttcctgaattcacaggccgtatctgtcccgccctctgcgagaagagctgtgtgctgaaactgagcatggactcccccgtcaccatccgcgagaatgaagcggccattgccgaagcagccttccgcgaaggttatatcagcccccggcacattgaacgcaacggacggaaagtagccattatcggcgccgggcctgcaggactggctactgccaaccagctcaacggaaaagggtacacagtgaccgtcttcgacaagaatgaggctcccggcggcctgctacgttacggcatccccaacttcaagctgcacaagcccatcatcgaccgccgtatccgggtgatggaagaagaaggcatccacttcaaaatgaacaacgatgtggatgtgcggcaactccccgaaggttttgacgcctactgcatctgcaccggagctccgaccgcccgtgacctccctgtccccggacgcgaactgaaaggcatccacccggcactggacatgctggcgcaacaaaaccgtatccttgccggcatgacgttcccgaaagaacaactggttactgccaaaggtaagaaagtactaatcatcggcggaggtgacaccggcagcgactgcatcggaaccagtaaccgtcagggtgctgcaagcgtcacccaaatcgaaatcatgccccaaccgcccgtaggacaaaatccagccactccatggccccaattcccccttgtgctgaaaaccacctcttcccacgaagaaggatgcagccgccggtggtctctcgccactcataagtttctcggcaaaaacggtaaagtctgcggtgtggaagtggaacaggtggaatggattcccggtcccgacggcggccgccctgtcatgaagcccaccggaaaggtggaagtgattgaagccgacctggttcttctggcaatgggattcctaaagcccgaacatccccaattcgccgaaaacgtattcgtagccggcgatgcagcaagcggagccagcctagtggtacgcgccattgccagcggacggaaagcggcaacggacatagacagttatctcaataaataaatcaacaaatacaattatgtgtggaatcgtaggaatattcaagataaagcaacaaacgcaggaactgcgtcagaaggcattgaaaatgtcacaaaagctccgccaccgcgggccggactggagcggcatctacgtaggcgactctgccatcctggcccatgaacgcctctccatcgtagaccctcaaagcggagggcaacccctatatagtcccgaccggaaacaaatcctcgccgtgaacggagaaatctacaaccatcgggatgttcgtgcaaagtacgccggaaaatatgatttccaaaccggaagcgactgcgaagtcatccttgccctttaccgtgacaaaggtattcacttcctcgaagacctgaacggcatctttgccttcgccctttatgatgaggagaaagacgatttcctcattgcccgcgaccccatcggagtcatacctttatatataggtaaggataaggacggcaaaatatactgcgccagcgagttgaaagccctcgaagggttctgtgatgaatacgaacccttccttcccggccattactattggggaaaagaaggcaagatgacccgctggtacgtccgcgactggtttgaatacgaagccgtgaaaaacaacaatgcctattcccaggacatacacgacggactggaagaggccgttaaacgccaactgatgagtgatgtgccctacggcgtacttctttccggcggtctggacagttccgtcatctctgccattgccaagaaatatgcaggcaaacgggtagaaaccgacaataaaaaagatgcctggtggcctcagctccattcctttgctatcggtctggaaggtgcgcccgacctgataaaagcccgcgaagtggcccgctttatcggaaccgtgcatcatgaaatccactataccatccaagaaggattggacgctatccgcgacgtcatttactacatcgagacttacgatgtcaccaccgttcgcgcctctaccccgatgtatttgctggcacgcgtcattaaaagcatgggaatcaaaatggtgctgagtggcgaaggggctgatgaagtgttcggcggctatctctatttccacaaagctcctacagcccaagcctttcatgaagagaccgtgcgtaaactaggcaagctccacctctatgactgcctccgtgccaataaatccctcgcagcgtggggagtggaaggccgagtgcctttcctggacaaagaatttctggacatagccatgcgcctcaatcccgaagcaaagatgtgccccggaaataccattgaaaagaaagtcgttcgcaaagcctttgcagacatgttgcccgacagtgtagcatggcgacagaaagagcagttcagcgacggcgtgggctatagttggattgatacactgaaagcccttaccgccgaagccatcagtgacgagcaaatggcgcacgcagccgaacggtttcctatcaatacaccgcaaaacaaggaagaatattactatcgcagcatcttccaggagcactttcccagtgaaagcgcagcccgcagcgtgccaagcgtacccagtgtggcatgttctaccgccgaggcccttgcatgggacgccgccttcaagaacatgaacgaaccaagcggacgggccgtgaagggagtgcacgaagaagcatacgattcataatatggcaacgtgaattcgattccgacaaattcatgcatatctttaacgcttctcttacagcattcattaaatgaagagatgctttgcaccccgaacttttgcgcagccttgcctccgaaaagaggaaggctgcgcggtgcttttgccaacgttttcgaaatagagtggaaaaaacagccctttccatgctgggtatcagaaaaaaatggtgtaactttgtatagctataaaaaagagaagaagaaagatggaaacaaagaaagcgcctcaaatcccttacggcatctcggactttgtgcggatgcggactgaaaattattattatgtggacaagaccatgtatttgcccctgattgaagatacagccagctatatctttatgatacgtccgcgccgtttcggaaaaagccttttcctaagcatgatgaaagcctactatgacattttgcaaaaagaccgtttcgaaagttattcagcggactatggattggtaagaattccaccgaccagcgcaaccgtttccaggtgatttattttgatttctcaaaggcaggggtttcattggaaagactggaaaaatgttttgagacttattgcaatgttgtcctctacctgttcataaaggattacgcttcttattattatgatgattttgaagaaaagcgctgtatctggctcaaggaaccacgttacataaagtcctgatacagttcaaaggatgggaagtggtgagaagtgaaaaagatacacattaaaaacacaattaacagataaaataatgaaaacaccttttattcctaaattgattctcctttttatcctattttttctttattctgctggatatgcacaacaacgggattcagtaaccatacgcggacaagtaacagattataacggacaacccattgacagttgttccatcttttggcagagcccttcttttgatgacattaaacaagccatcactgacaaaaacggatactacaccacccgtattcctaaaggaaagtatcaaagtatgggagctatcaatatgtctacctacccacataccgtaaaacccggactagcgaaaaaagaccaacgtctcgaattttgggcatggaatttcattgccgatcgtgataccactctcaacattcgctatcatcgtatggaagtctatggactacgtattttccacatccctggaggcatgcccacctatcagatatatgttcgacccatgagtctgacccgcaccctgcaatggcaaaaagaagaaaaatcctcacttgtacatgcacaggatcttagcaagattgagcaaacaggtttaagcaaacaagccaaaggcgttttgctggcaccatcggctgacaaactaaaagctatcgtttggatagatggagaagaagtacctgttctgatgaaacaagagataaaagagtacttcgatgctaccgaatacggcaatgcctatctgctgaccgtggatatgcccagacaccagaaaaatattctcccctaccgaatatttaaagtagagttaactgatttagagaatggtgaccgtggagaagggctttattatatggaaaaagagaactatataaaataaaaagaagcggtagaataccgcttcttgagccgaaaccgggactcgaacccgggacctattcattacgaatgaattgctctaccaactgagccatttcggcaactgttttttctgcaatattgggtgcttttctgaaaaagcgttgcaaatatatatctttctttcgaaataaagaaactaaaagcggataatttttcagttatccgattttgttatgtcaattgatgccggatttattggtaggcttcttcatgtatccctttcatggcccatccgcttggttcgtttatgttcttgaaagcggtatcccacgtaagagcttcaacggtagaattgttttcttttatgtaaagattataacatcaaggcgtaaaaactattttacactaattgctctcctcatcaaatacccgtgatatactgaaatttacccactccatacccaaacaattcaatatccgtcaaagtttgatggtctttaccttacccggaatgatggtcagatgcaccgttccatccttttctatctccaccttctgatatctggcctccaccaccacttttccatccagcgccatcaccccccactggcaggcattcccttcaaaagcacaataaccgcctacaggaatacagatattccggtaacaaggaggcactacgatacgatctccccatttcagcccccacttcatccccatccggaaaggaaggacatcttttatttcctccagcctcttccgccttttctcttcctcattctgttgccgttcccgctgtacgctctccgcacgccgcccggcttccttcctcagaccttccaccacggaggcaaaatccgcttcgcccgccttaggagcattacaagctatataccgcttcccctttcctttctccacatgataatagcttccttccccatccatcaccacaatgctccgatccgccaaacagccacaacaccagtacacctcttcatcatccccttccagcacgcaggcgaagacatcaaatatagtagaccacacaggatcaactagccggcaagacttcggaacacggtaatccggtatcttcaagtagaaaccataaaaacaaagactgtctttgtgcaaaccatgcatagaggtatacgccttccgcgtgcggctatggaaagtctcccccacccgcagcaactctatgccgccgtatgaaaaaaccaccggtctctcctgataagttctgtttgtcttcaaatcggtataacagtcactcccatcctctttggtgacagaaagaagttctcccttcaggaatctcaatctccggcaacagcctgtcaccaccatgaggactccggacttatccaccacccctgtccggccatctttaaaacggacagcagcccggtttgcacaaatatcaaatacttcccggtattgaggaatcactgtgattttgttcccgcacctcaagccccacaaaccactctgccggtcatgacaggctttcaaaacagtccattgttcctcaccggccggaccacctcctcccaaacaaatcaaatccccgttccgaatagcatccagcagacagttgtgtgtcatcacaatttccagtccttcattccgtttgctatcttccgatagcgaacaagacacagacagcccgttgttctccatccgtgtccggggctgagcatttcccgccatccgtccttcgaacatcgcctcccagtcacggtcacggacaggcagaccgaatatccggtgcaatcccacattatctatcagcacacatgattccttattatccgacttccgcagcccccgtcccacctgttgcaggtatttcgccaacgaaagcgtgggacgtgccagctgcacgaactccacatcgggacagtcaaacccttcagaaaaaatatccacattgaccaacacgctgatctttccccgcctgaaatcctctaccagtcttccacgttccaaagcgggagtcttgctgtcaatagcaacagactccacaccatgtaagctgtaataggctgcaatctgtcgggcgtgtgcaatacttacggcatagacaattcctttcttcccggcagcatatcttcggacactctcgtacaattgtctaatgccaatttcccgatttaacaccgcattcatttcctttacctgataatccccgtccgcaccccgtttcttcaacgagtcaatcagtcgctgttcgctgctgttcgcacggatggacacatagtcaaatgacgacaaccagccctttccgatgaattccgcaatactccatgaggtaatcagggtatcaaacaaatccgtgaatcctttgcggttcagccggcagggggtagcggtcatacccaatttcctcgcctccggatatttcttccaaagctcccggtaggtttccgccagagcatgatgcgcctcgtcaataacaatcaaatccggctgtccgtccacaatcttccgatttcgtgacaaccattggatagacatcacactcacacttccgtcctccctccccattccataacgggaaaccgtctcctctatctgctccaccagttcccgacgatgcgccacaatccatacccgggtaccggaaccacacaagaactccctcactatggcagccagcaggtgtgtctttcccgtgcctgtaggcatctgtaccatcacactccgatgaagctcccactcttcaaaaagcctgagcttcatctcctgctggtagtcacgaagacaatcattcttacaatacattatacggatgccagtctctaccgacaacaaaaacaaggaaggccgcatacgttatcgcatacagcctatagtaaatattctatctttataaatttattttatcagcggttatgaactgttcctccaccgaattcagacagaacctattattgtctatccctctatgatccaatcactcaaagtgtgactttccgagtcaaagtttatccccaccttcaccacgggaagtccgcaaagaacaaagcgttcgggatagttcttcagatttatttgggctaaagcggaatcagcacttttgtccagtttcaattcaatgacatacaaagtgtgggtagtacgcatcaccacgtccacacgccctttcggggtacggacttccacatccacatacatcccaaacaaagaaaagatgatgtagaatagttgctgataatgcccctcataattcgtattatcacaatacgggacggtggaaaggaatagttaggcaaaaggctttacatcaaccccaccctaatttcaccgttcgggatatccagtgtatatagttgagtcaacttatcatagtttttaattgtaatataaccgctctgataaagcagaggcacgatagttgtcatactacgctcggtaggggcatcaaaattggttgaaagcgccttcttcattccgatagcagacggaaacaccttgaacttgcgcagcatctctatcagataggtgggcgtgccgctgccaaaccagtaattgtctatcctccttctttctaaggcattcagtaggctgaacggattgtagatatcaggggacggccaagtgaaatgataaccgtcatatctctctttcagtttcagcaccgtttcctctttgctcatttcctgcgaaatggcaagccgttctatgtatcccgacatccgttccagcatttcctcctccgtaatgccacaaatggtagcgtaaggctcgtccatactgacattcgagatattgttcagctcgctgaagatgctgagttgcgagaacttggtgatgccggtcagaaacacgaatcgcagatagggatcacacgccttcagcggactgtaaaagttgcgcatcacattgcgcagtacagggagattctcctcctcgtgcatcacatccagcaagggcgcgtcatactcgtcgatgaggactaccacctggcggtcggtctgttcgcaggcacgcatgatgagtgtcttcatcctgtcgttaagagtaaccgctctttccggattcccgtatattttttcatgctcaaagagttgcacatccagcatactttccaatgtttccttgtccacatgcttggacaaactcatatcaaaatgcagtaccggatattctgtccactcggtttccagcttttcgatggcaagcccttcaaaaaggtctttcttcccggcaaaataactgtgcaacgtagaagtaagcaacgatttaccgaatcgccggggacggctcaggaaacaatatttggaggcaccgttcgccatccggtaaatatactccgtcttgtctatataaaggtaatccttgttgatgatttcctcaaaagtctgtatccctatcgggcatctcttcaactgctgcttttccatgatgcactacttttaccgtttatgcaaaggaacaaaattcaaacgggaattcctaatagaataatctattttagtttttatttcaagtgtactttaaagactaatccaccggagaagtatttgcagcggttcagtcctactacagcgttgatgtagtctttccaaaagctgtactccatgccgagattcacctgatatttcgccccatcgggattgaaagtcaagtcttccctcacatccgtatagccgggaactacctccgccattacattgacaccagtgaccgctttggttacccatgattcattttctttcagatgaaaacggaaattggcacccattgctggattgttcaacttattatcgaaacggttgctatatatccaggacacatgtgcacctaatacacctacattctcaaaatcgacatgtttggttatagctagataataacgattcaagaaaccattaccgtaattcaattccgagggtttggacaaagagccaccattccaagaatcaccgattgcatcattggcacccaatacaatctggggagtccacggtttccaccacccttctttccacacacgcaagcgaaaatgaaaagagcggtcttggtttgtgaacttaccatatttggacggtacccaataacctgagatattaccgtaatccgtgggaacagacttgtgccccatacacagatagccagcctctaaccaaggaaagatagtaatatttatatagtagttccatgtatcataccaccaacgaggaaccgtagcatgatggctcaaccagttgccacctgctataaaagtcttgtcgcgctgcatgtcagcggtaggcatgttcatcaagccggtagtaccgtagttaatttgagctttgagtgtaccacccaacactcccaataacaaaaaaaagaaaaatatcttttttctcatttcaaatactggttgtcattgtccttaaaccaatcagctatagcctcctcaaaagtataatggaaatgatatcccgaatcagccagtttcttgccacaaatattagtagagaccatcaattttctaacacgtgccggacaaattcccatgggggcacccaagcaaccgattaccgctgctgccggcatcaaaatccacgcaggaatcaaaggagcagtacggttcaatcccgttaccttattcattgttgcaacaatctgctcgattgtataagccggttcaaaagtacaattgtatagttccacaccttgctcgtggtgttccaaccgatacaacataaaacaaaccaattctttcacatagatacatgcctttaccgtatcctttctacccggatacatgaacttacgtccacgcaatccccaataaagacgggtaaaattaccattctctcctttgccaaacacgaccccgggacggactatggtcaattgtctttccgaagaattcttcgcctgccaaatggtgtgtatcttttctgccaccaactttgatataccgtaaggagtattcggagtaggaactgttatttcctctttcaggttctcagccgctccatacggagcaatggaacttgtaaagactattcttctaataccatacttttctgcaaaagctgtcacattttcagcacccaggatattggtttcaaaatattcatggtcagaatgaccgggagtacggtgcacagccgcaaaattaaagattacatcatcttccgtaacggttacttcctccaaatggattggttttcttacatcacaataaatgtatgtaacctttccttcctgagaattttccacaatatccaaattgtagatatggcagtgaggaaacctctcttttagaagattcgtcaaatgggttcctataaaaccggagccgcctgttataaaataattcatcgagaaaatagtttaattataattctttaccaatgataccgcactcataaatttcactgtatttctgagccatcaaatctatgttgtaattttcttccacatcctttgaggcacgttcggaaaaggaaacaccattcatctttccatttattatagaacgtatcgaatcggcatattcggctgccgaatgacaaatcaatccgttcacaccattgttaattacatcacgatttcccgtaacatcacttaccaaacaaattttctttaaatacattgcttccagcaacgaaatcggaagtccttcccataacgaaggcaatatgaagaaatccatctcttttagaattcccaatgcctcttccctttttatccatccagtaacatgaatattaggagaagtcaattctgatttaagttctccctcacctatccatgtaaactgagcttcaggaagcagcttcgcaatttcattaaacaaagtaggattcttctgataaagaattcgcccactggtagctattcgtatcggttgtttaaaaagcttacttatcgaacatacaaacggtttcaaattttccgtatgaataccattattcacataagtagaattgggagataatctaagtgcctctttatattctccttcactgcaagctatcgtcatacaaggtctttttgccgatacatactctatcaaccaaaacaaaaaccgcttgaatcttgctccatccttcattagaaaagaatatccatgtggagtataaaaagaaggaatattcttacatggtaacgcccatctgcctacaaaaccagatgctgacgaatgaaaatgaacaatatccggctttattttcttataccattcacgcacatcacgataggctttcaaattaattactgtaccaatggcgcctttgaaagagtctattcgaatgagatgcacctgcttatcaaacagttgttcaacattcttaggagtcaatggacgaacaccataaagaatatagacttcatattctttcacttggcgtttggttatatctacaagaaaactgagaacccccgttgcaaagggttctgccacatgcattatttttttcatagaagaaatgtatgaattcgaattacatatttacaatatataattgtataaaaacaagtaggctaaacaaactataatttacttttccactgaaatcattttcttgattttccataaccagcaaacaaatcgactacccacattcctcctaaggacaacaaacatgctatacgtgttttccttctagctttcctatccagcaatacatacattcgcttctgtcggataatgtccaacagattacgacgcatctcattttctttctgaggaatttccaatagtatatggaaagcaaaacttacaatacgacagcttaaagcatgctgtacccctttcggcatttttttcttatcggtttcaagctgacggatgattttgatacagctttcatattttaatggtttaaatggtgcaccttctatgcttgtatttcgtatccgataaaaataactgcgataattaccaaacgctatataatcacatttcatcattaagcggtaagtagtaggtagatcttcatacagccaacctttaggataacgaattccatcagaaaaaagagaacggtgatacattttagcccatgcacttgtatcaaatatctgttgatagaacatacctgtcaatgcatcatttgtatgcacaatttttacaaatagagggttgttagtacaaatttcagcagacgaatcatctacaaacgtttgatagctactcaccgacaatttcactccagattcttttataattttataaagatattccacataatcatccgacacataatcatcactatctataaaagtcacatattcaccagtcataacatctaacgctgcgttgcgagcatcactcaatccaccatttttcttatgaattatccgaatacgactgtccttagcggcatactcgtcacaaattcgcccacaattgtcaggacttccgtcatccactaaaagaatttcaagattacgataagtctgatttaaaatactttcaatgcacttaggcaagtattcttccacattataacatggaactatcactgaaattaaaggttgcaacatacaagaactaaagtataaatgctgaattatataggggaaaaataatttcagaaaataaaatattagattttcactatttctttagctttttcagccacagcttaatttgagcaggaagcatatttttaactctttgcatcaaagacaaatgcaaaggaaaccgagtcgcaaaatattccttcacatccatgctgtcaataccatcatagatatgattccgaatttcatcttttctttccgtaggatgttttaaattatggtttcctgcaacagcatattccaacttactatctttatattcgaaatcgccttccaccctcttccaaaaattcattcctacaacactattgagaagcattaacgaaacaccctttatgctataaaaatccgaatgatatttttctattccccaataatcggctatcgtaatatcacctgccctttcggtgtgcgcataatggcagttataacaacactccctataagtgtgtccctttaaaaaataagtataataagggtcagctgtagcactgccatacttatacttatacttatacttatacttatacttatatcctaagccccaacctccacgtttatcgcggaaatcatattcagttacctttccaccatgtctttgatgaagaaattccaaataacgcttaaacaacaatggagaggaaactccatgacaaatcaaatccaccagtatcaaattgtcgtaatcctttcccaagaaactacgcaatgcaccaatctgacatccagttccgctataaagcaccattcgctcttctttcaagaaccttcgtacctcagaaaaagtattttccgtatcactctgcacatatttggaactgagtaatgaatcgagttcatccaaagttaccgcactggaatggacagcacgcatctcttcatcatattttactccaaagaccactcctccgtgtcttatcacccatgctgccaatccagcaaacgctccaccggaagcacttctataaagagtctgttcatctttcagcctgacagccaatgtggaaagaggtgctccataaaacaaatcattacgattctgagggcaacgttttctgcacaatccacaatctacgcaacagttctcatcaatcgttgccgtcagaaagccctccttatcagcaatcaatcgaatagcctttttcccacacaattgttcacaggctctacaacctgtgcaatattctgttatttgtttcattctattgcccgtcttaaaaagtcaagtcctttcgccctctcttcatccaatatcttgttggcataagaaaaatcaatagcaggtgcttcaactagagaaaaatcatcataagaaagcaaatgtctatcctccaatcctaccaattttaaaatactgcccaaacgactactataatcattgggataaatactgataaattgagtattcacattgatgctaaaagcagtggcatgaaaagaatcagttatcacatagtctgcatgaaaaatataacgtacaaagtcttgaacttcgggcacaaccaaactttttccatttttcagaatctgatcaatacgggtacagaaccttaccaaccgtaatcccttacgatgtgcaaactcttttgcaaaacggtcaaaagacttgtttgtatttaattggtaaataagtacatacccatattccaaaggacggcatccagcgtaggaactccaaaaagttctatcaagctgtaaggtaggatcaagcacatgagtagcatcacaccccagttcgctacaaatatccaccccagtactttctcttacagaaacagcttgataacgggcaagcaacttacaggtttcctccttctcccatgtatccagtttactcttgccaaagctggcagagtaagctatttttttgatatgttccgggacaaaagcaagaaacaattctggaagaattcccccgttccacccactattccatgtctggtcggaacctgtacaatagatgtcagatgtaagttccaattcctcaaaatcagccatagtagtacataccttctcctgcacattcaagtgtttattcaggaacttcttaaaacgtctatcctgcaaaacgaaagtgggataaagcaatgcccctattagaactttagtaagcaaaggtttcttattagtccaattcttgatcctaacccaaggggtggcattattgctacgaagatagttaaagaaaccaacttcacaccctaagctttcaaagattttttgagtcgctaaagcctgcaacacagaaccatagttacggacgttctgaagagttatgatagttatggttttcatcatctcttatattttataacaatctaattaggtataagtaactactttaactttacagttttttacaaagtaaatacttattaaccaccgtactatgtgctgggcataatttctctctatttttagttctaaaaatctgatttagaaagataaacataatcaatattcttttcatcgcaacaaaacaataaaatcattctacaaatccattaacgattagatatagttatccaattatcaagaactacaggaggagaaggtcgatcattacgccaaatttgggggcaaataactatcggattatttttatttaagtaagcagcccaacaactaaaagtactattggcaataatcatattttttccatgagccataagatacatatcaaaaaaactacgttcacccttgttccatgaaatcactgttttttctacatcatcaaagtattcatttacgtaatcaacattatcagaaaagaagaaaaatttaggtttgtcaactttatccagtattatcttaagagctttcttataatattcaatcgtacatattccaccatatatttttcgagctttagcacttgtttcataatcacctctacgtacatgaacgacaacagaattattatctattatatcttttaaaattctttcattatcatttcctatagtgacatttattttaaattttagtattcctgtaaaaagaaaatactctttattctgccaataaccaaaataaaacaatgcattcggcctacggaaccaatcagtatctgtaaatggatatttcaaacgtagcttccggataaatttattaacccaaaataaaaaattagatattatatctgatgataagcaagtattaggtaaatcaacttcaaaccatttattaatttctaacccattgtgatcttttaaagcaagtttcggataaaatccataaaaagtttcttcaggatattgactacgtaaatattgataataaacgtattgaaacatctgatttcccaacccaccctgaaatgttataattttcataactaaaaaactatctattgattattgtttctaaaagagttatagctttatgccttctacaattttcttgaacaaactgcttacccaacttacccagtcgcatacgttcctctttattattccacaaaaaagtaattttcgtatgcatatcggttatagaatcaacagttactcctccaggaagaatacatgcattacccacattagtactaataaatggcactcctttagccattgtttcaacaagagatatagaatattcttcaaaattacttcctacaagatataaagtcgcgttagccattatattaggtatatatattcgtggtacttttaccaatacctgaatatctcttttaccatattttatagtcagtctatttatttctttttgcaataaataataatattctgttttctcaggaccaatgaatactagacatgcctcaacaccagatttgaaatattcacgtaaaataccgatttgatttttctgcttactataagtacacacacataaaagatatggtttatttagttttgcaatgtgaggataagaaattaactttgatgtttcacaaaacatgtcatcaacagcattttgcaaaacatttactttcttcgcattcttcataagccatactttgctgctatccatttctgataaacatattgtttcatcaaattgcttaatgtatttcttcaatgtaaaggagtaatatattttaaaacgaaaccaattatatgtattgcccaacgtatatttcaaattaacattccatttaaaaggtaataatctcatccctgaaaagccatgtgaatgaaatattttctttccttttatttggcttaaatttctcaacagaacatctgtagtaacacattcagaacattcaaatataacgacatcagcatttaaagacaaaacaaatttacgataagaatctatctctcctacatatctcttcatcaaagttttacgtaaccgaaagcgataaacatgtattccattaatattttctttatcagatagcccctcataccattttgtgcatatagatacatcatatcctttctccaacaatccttctgcaagatattgcaccacaactggtaccccactcatgcgcggataataattttcgactaaaaataatattgatttcataaatcatatatccagtttgtaaagctcaccgatcagctccaatatgaatgcggcatccttgtcaccgccctgctccaaagcatacttgaacttcgaacgggcatgggccatgcaacaaagatgttctatatcgaccatatgatcatccagatacatatacacgttatagccgtccgactgaagggctttcacctgactgtcacccaggatatgcttcagggcatcccgtcccctggaaccgtcctcgtagcaatagatcaccactttggagagtctgttgaccagacaccatatgtatttcttcttatagcatccttcacgccttacacggcaccaggtctcatcacagttgacaatggagtccttctccaaacaagtgttcttaagataactaaccagcccacagagatgaatggagcctttctccagccaattggtcagactcatgcggctcacacgcatcgattcaccggataatctgtacatctcacgataaagaggcgtatccagaacatatttgttgaaagcaagataagcaaggaaagaaccggaggcgtgtgttcccggaacaacgtcaatgatttcaggatggccgctgaaagggaaatagccttcgtgaattttaccgtcagccgtcttatagcggataacctcgtaatcatgctccaccagactgcttacctgctcgtaggcatattttcggaaacgtttgatgatgacggaacctgcgggaagccggccgatgtcactgttgtgacaaaccgtattgtcggcactcatggtacggtaagaaagtccctgacgataaagacgggactcctttgattttgcttcagaaccctcttcctccaccgcttccccgccagcctccccagacggagatccgatggattgcggagtaccgtcgaagtcatccttgtcacgggtatggtcctctccgtccttcacacgctttttacggattcccttctagctcttgcacccataaaggttcttgttgcggactttcagccgctcctccaaagctgttattttagacaacagattactgaccagttgtttataatcgtccaattccttttctgcagcaatggcagccttctgcaaggacaacagttcgtcaaccttggacaacagcgcgtctatgcgcgcctcgtcacgacggatacgttcggcatcccgctcacgggaagccacaagctccatgatcattttagatttctcgtcgggggtcatatctgaatatgggtcttcaaaaggggcaggagtatcctcccgttccttaagcttccttgcggaagaaagcagtctcattcgttccaactcattcatattcagtatctttgtttactcaaagatacaaaaaaacaatgaaataaaagaatgttttcgctactttttatttgttaattatttgactttcaattctttaacaacaggcgattccaacaagagaatgacatcctgccaattgattgaataaatactttcattaccattataggttacctgcataaacttgtagccgggtctgaaacgtctctcaaacatactgtaagaacggcggtcatagctgaacaaacgcaccagacgtaaatctttggacatcacgataaagacatcgccgtctttcggttcacgattcaactgctgatggatgatggataagaccttatcatatttgcagcgcatatcgtggaaatcgcggacaaggaaaaaacggttgagaccgattatattcaacataagacctccagtttctctaccagacttttcaagcccgcgtagcttaaatttttctgactgatatgaacaccgttgctcatacggatggccacctggattcgaagtccggtactcgaagaaagccgggaggacacttccgcagttccttccggaagcggggaaggaatttcctgcatttctgattccggcgagggagcacccaatacttgaacaggaactatcttcttgcgggtatccttgtactatttggaaaacaggttataagggacttggttagacaaacagaattgctcaatcgaaacaccggaaggaacaccttccaatttatagcgtaaaaacagacgatcaaaatcatggtaactatacataaacttggcttttcatttaacggaagcaaagttctgacttttatatcgggtatcctatatgtcatttttggacgctaacttgagagccgacaggcactcggattggtattgcataaggagtgtttctttagtcataatcagaagagttgaaaaacttctaatttactaaaatccaacgaattatgcaacacttttcacccttgtcttcagcagattagcccacttttttcagcacatttcttcatgcttaaccattcgttttgacaacatttcaatgacctctttagtgttttcgaaccgacttttgccggttctatcgtttgacttttaatttttcggtaaaaatttaccgaagtattgtaataaagtagatgcgtcaaaccttacgctataagggtggaatacttctccatgaggcaaagcctcggtctggtactgaaagtaaaacctttcaagatcttcactgctatacataattctaaaatttttgttcgcagcgaagatagagctttcaattatgagccaatttttgactgcttacatttcaactactgattcgcattaaatataaatgattaagaaaagagaacttcatgttcttttaaccattttgataagtaacgataaaaaatgtgagccttttgataaggatcacccacataaccctgtgcttggaattcaggtataaatataacagaatctccttcaacaggcttagaagaaaaaaagactttctttcgaaatggcaaagcgtcaaatgcctttatatcagcctctgtacaaccattctgatccataccaataaagaatgcatgttcataatctatccgttttgcccttcgcttccattttttccaagcttctatacatgaatcataatgaagaaaatgcacctctatctttccgtctataagtcccattggataataatgttctgctttttctctatttaaatttcctatttctgtttttgagcattcagtccaaattatctcagaattcaaaaaatatggcatttttttacaaaattccacgtaatcagctggcaagaaccacaatcctactgtaggtgatgtatattccatatcaaaatcctgatataaacgtccagcaaagcaattacttgatacaaaactctttacaccgcccatccgcagatattttctcactatatatatatatctaaatcttttcaaataaagacaaacatttttacatttcctatagcaaatcaatatccatgaattttcacctaacttatttttaataaaatgcttcatcattttatcatattttcttagttaactcaaatgaaaggaaagaacgaaaatgtcccaacagttccaatatcacaggtctattttttccagaaacaaatgacaatattttataatgttttaccctaagatgatgatgaatacaatacacattaagcaaacgttcggacataaatccaaaaattcgagcttgataaggagtataatattgaatatgtacacgttcttccacttttttcaataccccaaaaagccattcacaataatcatcaaacagttctttccgacaaatcatcatattacatggactataagaattagaagaatacatcaaataatgaaaagaatcttcatattcagaataaaattcttttataacttcttctaacacatcaaaatcttggcgagaatgattaatagcataatattctcccaccgtattcttaacatgagttttattcggcaaaataatatcatatttctctaaatcagaaataatacgtttttcatcgcatacaatatcaggcttcccacatacatatttttgtacaccaatattaaatatgttattttttaacaagaaataacgacgataatggcaaagaccaataatatcaacctcttttagatttttccatgcccaatataatgctgttaactcacaataatttctatttttccagcttatattatctcccgtatcatccccttgtattcccaaatctacactactaattgccctacctacttgaatgggtaaaaaaggatatttttgggcataataatcttgtttatggcaacaaaccaaaattgttattttattattcatagacatttatatttctagatattttgaatgatatggaacagtttctccataatttgaaatccatatactaataacaaaattaaatacagcaattactaatactaaccatgtaacgcatttccgttcgcgataaagagaaatagaaaaaaacaaaatattgacatatgtaaaataaagtctaattcgtgaaactatttcgccacctagtgaacaatatgctaatgctaaagacataaccaacgcaaatattgtcaagaaattctccactttgggtttatttttcaaaataatcaaaaaaggtattatatacattatacagataagaatagcagtcttagaagtttctccataatcacctactgcataacgctcgtattgtgaagctaatagattattagataaagctatagatataaggttataaaaaagtatgttaaatgaaacaacgagtattcctcccataaataaaacaaaaagaaaagttttctttataccaaactgttgcacacaataatatgctataataaaaagcagacctataacagaagttgaatgacaaaaatatgcaacaaccataaatgcgaccacctttatatactctttacgcatcaaataagcaagcatacacatcataacagacattgccatactctgtctcataatattcaaagactgattataagccatcaaacaaaaaaaagaaataaataatactattgaaagttttttccgcatcaatgtagctgcataacaagcaaatcccattatccacgcctcaataagaaaaaggaatacaccaaaagtatcactaaacaagtgaacaaattttgctaaaaggacaattgtaagatcaatttcagcatcttccaaatccaagtacgcatcagtatgaaatacacgataagcataaaaagaaatatcagtacctatattatcattcctagctccagcaataaaagaattaagaaatacaataactataagatacaaaaaatatatcatatcattttttcttcgtctttctgctaagaaagcaaaaaaaatagatatagaaaaaacgaaaagatagactatcattctgtatacaatattagaataaactaattaaacgatccttaatagaatttactatttctatcattaattcttccttcatcaacaacaatacccccccataaaatagaacacccgcaaaaagcacaacaattaaattcaacacttcatttacaaataaattccgaacacaaaacaaaccgacaagcataacaatggaagcaattatataataaatatatgatttattacagaatcggaatgacacaaatttacgaccaaaaacaagcatgctcatcgttacggcaatctcagctatagtagtagagaaagcagcaccatcttgagcataaacaggaatcaaccaaagattgaggcaaaaattaaaagctgctccaatgcctgtggccaatattacaatatttactttgcccattggataaagtacttgtatacccgatactccagacatacttatagcaagaacaataggagacaataactgaagagtaaagattgcatcatgataggtagaacctgcaaacaaatttattaatataggcgcagtaaatattaagcctaatgtaataggaagtgatattccaaccatgaaacgcatggatttacggtataattgttcaaatttatctttttcaccattagctatcaaataagacatacgaggaagcatagctgtacctaaggcactgctgatacttaaaagcatgtgagataatttagaagctgccgtaaacaggccaacagctgtatcccctgccataaatcccaacattatggaattaagctgcacataaatactaatgactaagtttaatgcaaaaacatgcaatgctggcaaaagatgacgcatcggatgtaactgccttatattcagttggcgtaaagttatatattttcgaagcctaataaaattaaagatgttaccacccaatacaccaatcaccgtataaccagcatagcaataaaggtcatcctgagtacggacaaacagaaagaggagcaagacagaaaaaactttaactattaatccacgaatagtaatatatttgaaatcctcaattccctgataaaaccattcacatcctattgcagtaaaaaatatcgtaagactaagaataagaaacaaaggaatatcgaccttcacttctgccactgtgtttgctattattgccactgctaaatatcccaagactgtaagcaaggtatgaagcaataatatttcaaccgttgttctttcccgtacttccttatcattcctaacttttgcaatttcacgtacagcatacatagggataccaatgcaagataacaatgaaatataagaaataatagactgataaaaattgacatgcccaataccatctgccatcattatacgagatgcataaggaaatgtaaggagcggaaacaacaaaccgctaattgtattaagaagattaaaggcatagtttgcctttacagattttaccataaacaattagtaggtagtaagcactcaatttagggcatcccccttcaaaagggcacttttcagtgccctaaaccgagttttgttaattaattggttttgaatttaacattggctggcagccaaagtgattttgtcaggaaccatattaacataatccctgcacccgttaaagatatttttgaaaaaagttccgatgaagttccagatagaactgccatgaagctttaccgttcctatcacactgtgataagttgtaagcactcaatagcgttcaccctcttaagaatcaagaggatgaacttttgagtattttaaaatttaacgatttataatgtattatatagccattgacataggaacgaggtcatcataattctcattcccgtccatcaaaagcttgattgtagttgcgatatagtcacgggcattcagccccacattcttgcaggtttcaatcagagtaaaaaatgccagtgctgtttcaacaccctcttcgctgctaaagaacaaagagttttttcgatgtaccgtaaaaggtcggatggctctttcaacaagcatattgtctatcgtatatcgaccatctttcctataattctgaagttcctcccaaccattgatcatataactcagcgacttactcatcatctcaccataatgctttcgtttattgttcaacagtttcattgcctttttatatatagaagtcaatatctgagttacatcatcctgacaccgtcgcttctttatctcgtgaggcttcaagcgtttcaggatacattcagcctctatcttatataattcgcctattttcaaaacgaaccatccggcattggcatccttgttcgcttcaaaagtcatggcaaacttattacgcacatgcgaccaacagagaataaactcacatgtaggatgagcctctgccaagtgcttgtaaaccacatatccatcagattgtatgcttcccaagaaatttcccaaaaacgtttcaatcggacggctaccacggctatcatccccgtcattgtcgtagaagaaataagtgatattctcctgtttgttcaccaaagcccaaacgtacttcttatagtaatgacccaattgggtgccatcacctttaatctttatcctcacccgcaaccaagtttcatctatattcaatacagactttattttcagcagcttggacttcaacgtcgaaagaatgggacgaaacattttcgctcctatcttaagggcattggatagggtgttgtcactaacggtaaacttgtcaaggatattgcgaattcgttcacgcgatatacgggagtatgcagctgataaacgtcactcgcaacatcggcaaacagatccggagtaagatgcgtaccgggaatcacattcgctcccgacatcgtattatctttttccggatgtaagggacgataacactcatggtaaacaccttcctcatccttaaatacagctacacggtaacgttttaactccacatagctgatacgattatactcatctacatctttaaagcgaacaaacacccaatcggctggaacaccctccagcgaactttccaaaacgacttttttggcagcatccatttgggtataagaacctcgaggaccgcgttttgcatccaagtgttcagacttcaccttggttttatccaagggctcttctgaaacattggaatctgtcttttccgagtctgccgaagcagagccctcgcactcttccttttcttcttttcttcatcacggctacgcttctgagtaggacgtttgaacttacggccggtagatttattaccaaaggtcattttgttatgtcggttattcaaatcacgcaaatcggaaatctctttttcgcgctcatccagcttattttgtaaatccgcaatcatcgagcgcaaatccgaaattagagtcaaatattgctcggaatgagaacggctacgatccagttctgactgcaggttacggatagtatcctgcaatgaacgaatcatatcattggagttctttatgatttccttcaggtcctgcatagtttccaaaaatgcttcacgctccatatcagacaagggttcttctgctccggattcaagctccaaagcattcagataatgagatctcattatcatttcttccactgtctgatctgtctttttcatacaataaagatacaaaaaatgtttgacaaaacagtgaaattaataatctaactatctggtttgcagttaattaatattaaataccaattatcttaacgacaggacattcaagcaatgcagccaggtatttaaaatccaatccatagataacagtattgccttcaaatactggttgcaagaacttataacctttctcataagtgatatcataaaggaatctcttatgatttttgaatcgtataatcttaagcgtttgacggtctttagacaggaatacataggcatctccattaactgagaataaacgatgccattctgccggcagaaattaacaatggaaatccccttaggaataccttgcttcttgtagagttcatagatactctgaaaatcttcactacttgccataacactataatttgggttttgtagtgcaaaggtatttgcccattctgtctcatcctaaaacgctattgagtgcttacaaagtaagatatattcccgagcaaagtaagtagacttaaatcgcaaagtaagttcacttactttgcccacgaacatatcttacttttttttccacacttgtcaccggtttttcacctccggtcacaaccgctttttcggtcgtcttgcccaagcgttattgatacgcgcacggatattactaatggtcttgcccgatacaaacaaaggtgtaagaggaaggaacagcgagataaaacgctccttcacaatctcttccggagtgatcttcggttcccgttcggccatattgactataaccctagccagttccaccgcattggtgcattccgctatctgcaccagatagatacgtaaatcctccaccttatttatataagagaaaaggcgcgtagcctcgggagataaagcaggttcctcatccttgtttacgtcatcctcctccggttccgcctcatcagcgtaataattctgtgtggcggaagtagcattgggaagaatctggttgctgcctccataaatgttgaagacgatgctgaagtgtgtctcactatccataagcttattgtttgaatgattcgtcaacgggtagttaacggtcagtcaatagctagtgaacggcagtcaacagttagtaaacgataataaatagatttttttacggtatttccccgcattaattttgtcgtgtcggaaggatgaacgaacatcccggaaacacaaaacttttaaactttattttattatgattgattacagtgtatttatgatgggcaacccgatggatgtcgatgccgcccaaaaagcgtatgcaaaagctcaagtttctgaaatcatgccattcagccagtttgtcaaacacattgccgaccacaatggcgtattcactcgcggaacggtaaaaggtgtaatagccgatatgtgcgagtgccttgtagaaatgcttctggagggcaaaaaagtacaactggcagaattaggtaatttctggatttctataggctcggaaggtgcggaagacctgaagaaatttacagaaagcaacatcaccgccgtcaacattgtgttcacgccgggagaagacttccaaaatcttcgttcccgcgccgctttcaatcccgtagcaagccgcatagcccaagccgccaccctgaaggccgaaaaggccggtaaaggcacagtcgacttggatgccgccaaaggaaagaccccggcttccacgaatgaaaacaatccgtcattatgataaaataccacattttctcgatgggaaatgcgtccgacaggacgatgcccaagaaagcatacgcaaagtgtgtgcccaacgaaacggtttcgcataagaaactcgtaaagaaagtgacggaacatctccgctttttcccacacggcatgatggaagcggtgctggaggaagtcttcaaccgcctgtccgaacatcttgcccaaggcgaccgagtcaccctggacggcctcggaacattcagtgtctccctgaaatgcgaaggagccgcttcggaggctttgttctccaagaaaaacatcaagggcgcgcacatcgtgtttgccccgtgtcgcaaactcaaggagacatttgcagatatggaatataaaatgattccacgaatcttttaatgtcatggaacttatattattcatctatttaaagacaaagcgtatgaaaaagaactggaaaaatgtactgctgtacatcgtccgcatcattgaactgctcattacaggcgctgccggaggagcgcttagaagcggcttatgagaacggtttcgttgattatcgtgcactgctctgccaacaaggcgggcagtgccttgcgagcggaggacattgaccgctaccatcgttcattgggctggaagtgctgtggttaccactatgtgattcctacagacggaacgatagaagccggacgcccggaagagttggttggagcacattgcaagaaccacaacagtcacagtataggtatatgctacataggcggactggatgatggcggaacaacgccgaaagacacccggacggaagcacaaaaggctacgctgagaaaactgattgaacaactgcatcaacgttatcccaaggcactgattgtaggccatcatgacttgaatccgcaaaaagcctgtccatgtttccatgtcacagctgaatatatagacttgcaaccttagttgcgtctgtagtcttatctgccatccatcgtcctgcaaggaatatatggatggctttaattaaactaatcaattttttcaaacggaaacgcatgaagatagctcactgccaccgtcatattgccaaaagcgaataccagccttgtattgcggtgcaaacgcatgatacatccctctttcccccgaaagacaccaccggtaatacggattcgttgctttttctgaagatagtcctccaaaggccggttcatcagctcgatattgtaaggcatggattcatacagatagataaattcctccatctgacgttgaggaattaccgccgcacggtgtgtgttatagtccgtcaccagatactggcggggaagcatggcagacagaatacattccaactgccccaagggagcacatacaaacagccaaccgttgccttcaatccctttctcgttcgtcaacgtattcagtttctgagtggagccggtagcaaaagcctctttcaccacccgggcagagtcacggcgagcggtatattcctctttggtataagcacattgctcgaaacgtttcctatgatcggtggcagtgtaagaaaacaccttgaagcaaaaaaatctctcttctacggtacctgatggtgtacgaagccgaacagctttcctgccactgaaaacactgatatagcgtttcagttctttgttggaaagatacagataataccagctgagttcagggtgttcttttcctattcccgccattggcgtgattccttcatttgaccccaggtctgagccggaagcgattgaactgcagagcagtaacttaggcgcttcgcccgttatgtcttgatttgaaaggaacgcttgattttcaagctccatactattttctgttaccatcaaaacattactttttatgtatgtctttttggggttctcttagtaagagaaccccaaaaagacatatactactgacaataagatatttacacataatcagagatggataatttgcaaacaaatattataagaatccttatcagagactgattcctgaataaaagatttccgtatttggattattatagctacatttgcagcggaatggggttctcttactaagagaactccattttttttattctaacagattcattttcaagatagatccaagaaagaccaaaaaggaacacataaattccttttccgcactcattaaaagaacaaatgataaaacgcaaaagcggccacttacgataaaaatcgaaagtgaccgctaaaaagagatttatttctctaatataaggatctaacagtacggagttacttcaccacaaatcctctcttatccaaataagctttgaatttatgcaaatattcttcatccggaccatcaaagaaggatacaccggatgccccgttattgtacgcttcatccagcgcctcttcaaaattgtccttaatatcaccaaacatcagtccggcatatatcttggcacgcccattcaccgtttcaacgctttcctttaccgaacgcccgatccattcaggaccttcataatagaatttattataaatcatcggataataagcatccagcgtccattctccccaatcttggcgcaccatcttgcgagccatggacggtcccgggaacactgcggcagaaatagctttatgatcggctttcaccgctttggtaatggcatccaccacacgagtgatggcatccagacggaaattgatccaactctggttttccatcggatactttaattccaacggatcctgtcctgttttagctttaaacaattcacggcagacatcacaataacaatagtcatattccggcaactcttctttctgctctataccatagtttttccataagctgacaggcaagattacatccggcatacggacataatccagatgaacaccatccacataaggcttatgggcttcctttacatagtcttctgccagatactctgccacaccttggtgattagggcacaagaagcgataataatccacgtaggccggtttgtcgtgacaagactcgcctttacggttcacggcataccagtcgggatgcttgtccagcagttccctgcggttcatcgtccatttccaataatgtgcctccagtccggcttctttgcaaagacgataaatattttcattgtatccctcgaacatgacacccgaaataccacattctttcaacaacgcaaaccattttttccattcggcatccgaacggttattcagacgcatccacaaccagtttttaacttcacgggcaggtatcttttctgtccggaaacgtccttcattatttattacataacggactccttcagcaggattggttatagctatctgataggtattctgagtcgcttccaccgcaatccgggcatcagccggaagagccttcaactctttatcagtcaaaaagaattgttctgtggcacgcaagtagttatgttgtttactataattatcctgctgtgcgtagaacatggcccacagcagtttataaatagcctgattgtacggataaaccaactcatcctgcgaggttcccactttcttgtctacgaaataaagatatccccaacggtcgggcatgtgcatatcgattcttccggtaggagtccatacccagttttcctcaggtcctttctccttcagccactgcacacgcgagaagttgatgcgccaggtgttgccggccttcaacggattattaaagttcatggtcagcgcctgatgaggaatggccatttccacactccaatacttatctttatcttttgatttattcagtgtaccttcacaatggatggcggtcttcaatccggggcagtcccattgcaccatgaaatttccacccgaacgataaggtttgtccagcatcaggtcgaaaatcacgccacgcgcattggtttctatttcaaaataattgtgtccgtcgctatccggatcgataaatacttcaaagtcattgtcataatagatgatggtatcacgctgggtaagacgtgccttgatatcctcttcttgaagaacagctcctacatataaatattcatcatcccacagcatcttggcggtagtttcatatttgggagtcgggaatccttcaccgcttatatctacaaacggagcggtaggcgccgccttcttccaggaactttcattcagtttaccatctattttcaactttccatccggacgataacatacataggtacgcggttcggtcagaaaacgttcatattgttcaaaaaggctttgtgccattgccggaaaagtaaccagcagaagcaacagggtataaataagtttcttcatctatttttctgattcagattagttattatcttgcacttgtcccactccacgatagagtttgatcggtccatccagcaacacggccagcacggtaatctgctcatcctgtacctgttggggtacatcaatataaagattgcccggtactgagttccaataatttttattgtagaccttgtaattcaacatagctccgttaccaaccacccatatacggttcactttgttcatcagcccttttacttccaccggaccgttaggtttgtaagggaggtataaatacagaatatcccccgccttattcagtgtggtatatccctggaaatgctcggtaggaatccctgcgcgagtttcataaatagcttctttatgcttcttggtccatcggccgaactccttcaacacagcgatctgttcttcaggaatggaaccgtcttctttcggaccgatatccaataaaagattaccgcccatgctcaggcagtctacaaatgtacgaagcaagatatagggtgatttataattgctgtctgtatgctgatatccccatgaatcattcatggtcatacaaagctcccaatatttatcctcgggacgcaccaccggcactccctgttcgggagtagcatagtcgccatatccctgtatgcgcgaattgataatcacattcttattatccgaacggagcagatctacaatatctttggaattccaagcttccgcactttgttcccagtctccgtcgaaccaatacagatccggtttccaggttttgttcagctccgccaattgtccgaaattgaacttgttgaatctggcccaacgttcaggatcatttttataacgtacttccgtacgggttttgttagggtaatcaggatgagaccagtccaataaagaataatagaagccaagtttcaatccttgttttcttacttcctttacaaagggagctatgagatcacgttttgccggagtgcttttcacgacgctgatatctcctactttggtatcccataacgcaactccgtcatgatgtttggtagttatcactgtatatttggctccactttcttttatcagatccacccaagccttcggatcatacttggaggctgtgaaacctttttcctgctccatgtattcatcatagggcaggtagttgttaaagaaggaccagctttcggacactcctctgacggaataaattccccaatggataaagatacccaacttggcttgtgaaaaccattccattctcttgtctttctgctcgactgtttcattctgtagcgtatcttgtgcccgtaaaggagaagctgcaattagcagactcaggaacgctaacgataatcggttctttttcatatataataggtttgattagttaggatagcatatcagtattattaaaatttacagctatataatggacaaagataatgtatttttatattttattctatctttgcacccctaaaacagaacaaatatgagcgcaaagaaaaagaaacaatccaatagtcccctgagagtcatcattattttagtattactgggacttttggcatataaacatcaattgtttgacgggaaactgcttgaaaatatccccactatcgaaagcaatgaagaaaagccagaaatactgacctcgccccagcatggcggtgcattggaaattccgatgatacaatcaagtacaggcggccagattctgaaacgtaaaggatataccctgtcttataatgccgattacaaaactccacaatgggtggcgtgggaacttactaaaaaagaaacaaaaggaaaagaagggcgaacaaataaattcttgcccgacccggacgtacgtggagccaaagcatatacgggagattatacaaaatcaggatacgaccggggacacatggcccctgccgccgatatgaaatggaacaaacaagccatggaagaatctttttatatgagcaacatttgtccgcaaaatccgaatctgaaccgcggcgactggaatgacctggaggaaaagtcacgccaatgggcaaaaaaatatggagcagtgtacattgcctgcggccccatatatgatactaaacgccccaaacgaatcggcaacaacaaagtggcagtcccccatgctttctataaagtcatattgattaatgataagaaaaatccgcaagccataggatttatcttccccaacagcgccggacataagccgctgaagaaatatatagtaacagtggacagcgtagagaaaagaacgaatatagatttcttccctgccctgccggatgaggtagaaaacagaattgaagcagagagggtacaagagttaccgtaacccatcacatacgtacgtgtggcgcaatatatacgtatgcatagccctacactgacgtatgtgaagggctacacgtacgtacgtgatttatttcacttccaacaccacgatagacttggcaggaagagtcactttcaagcttcccttattaaccttggctccggtaaattctttcggggcaaccacactcggtttctcgaaactattgtaatcacctatattgttagcggtcaaaatacggccggtaacactcttagctttcacctcacccagattcaactctatttcctgcgattcctgcaaatccacattagacaaggaaatatgaataaaaccgtttgcatcccgtgaagcggtagcacttaccatcggaacaatgcggtcgtcacgtaccaccttgcgttcacagttcagttccaaaggaagataagtagcatcttgatgcactttatacatttcaaagacatgataggtcggtgtcaaaaccatcttgtcttccttggtcagaatcatagattgaagcacattggcaatctgggcaatgttcgtcatcttgatacgatccgtatatttatggaaaacatccaaagttaaagaagccacgaaagcatcacgcaacgtattttgctgatacaaatgtccgcggaccgttcccggttcttcatcccaccaggttccccactcgtccaccatcaggccgatttgttttttcggatcgtatttatccataatagcgatatgcttcttcaataccggttctatttccaggcatttgcccatagtccaataataatcatcattagtgaactcggtagccgaacctttgcttccactccatccggtcactgtataataatgaagagaaagacctgccatgcgatggcccacatttttcatcagcacttcggtccaattatagtcataatcactggcaccactggctattttgaataaatgattgccatcataattacgacaataggtagaataacggcgatacaagtctgcataatattcaggacgcatactgcctccgcatccccagctttcattacctaccccaaagaatttcactttccatggtttttcacgaccgttctccttacgcagtttcgccatcgggctaccttgttcagaagtcatgtattccacccatttcgccatttcttccacacttccgcttcctacattaccactgatataaggctcacaacctatcagctcacacaagttcagaaattcatgtgttccgaaactattatcttctactgtacctccccagttattattgaccatccggggacgattctctttcggaccgataccatccatccaatgatattcatcggcaaaacacccccccggccaacgaagcaccggtactttcaagtccttcaaagcctgaagcacatcattacgatagccttgggtattgggaattttagaatcttcacctacccacaaacctccatagatacaagtccccagatgctctgcaaattgtccataaatatgtttactgatgatttctttcccttgctcgggatgtacattgatagtcgctttttgttgagcaaataccggcattgcagcgaacaatgccaagcccataagtgcatttttcatgattaaaaataaaataattaatatactattttgcgttctcgttttttgtttggtcaaatttacacattttacatcaaccggatagtggacaaaattgtatttttaggggtacaaaatcgtcaaaagtagaaaagaaagggatatttgcctatatttgcatacaaaaaagcccgatagactaaaatgaataaaaagaaacgtactattgtatggatagttattcttataattatcctagtgggagcaggtggcgcaggaagtatatattactatttctttgccaagcagctccaacttacaaagactacctatatttatatagacagagatgataacctggattctgtgtaccataaaataatccggaacggacatcctaaaagtatgttcggttttcaatatctggcagaaaaagagaagtatggcgacaatatacggacagggcgttacgcactcaatccttcagacaatatgcgctatctcttccggcgtctttctatgggatatcagactcccattaatctgactgtacccagtgtacgcaccgtggacagattagtgcgggccgtttcacgccaactcatgattgattctctggatattgccaaattaatttccgacagtgcttattgtgcacaaatgggatatgcccaagagacactcccctccctttttattcctaacacttacgaggtgtattggaatatgagtgctgacgcttttatgaaacggatgcaaaaagaacatgccgccttttggaatggtgaaaggttgaaaaaggctcaacgtatcggacttactcctgaagaagtatctactctggcctctatcgtggaggaagaaacggccaatggtcctgaaaaacccatggtcgcaggactttacatcaacagattgaataaagggatgttgttgcaagcagacccgacggtaaaatttggtttgcaggaattcggactgaaacgcattcttttcaaacatctggaagtggactctccttataatacctacaagtatgcaggtttgcctccgggacctatccgaatcccatccatccaaggattggaaagcgtactgaactatacacagcataattatatttatatgtgtgccaaagaagatttctcaggcactcataatttcgctgtcacagcagcccagcatcaagcgaatgcaagacgttatcaacaagcgttaaaccggcggaagataaaataaaagggaatacttcccttttattgaaatcaccctcgttacagaagttgaactgcactcctaaagttttgtgtccaacttttggggtgcagttcaacttctgtaacgagggtgatttttagttcatgagggtttcgacacaccttccaaatggatagataacttaatgtctatgtatagaatcttcttctttagaatataaaaccaatacagaccatttctcgcacttataagtctttcagcagccgtcctttgtattgtcctttcttcgcagtaacttttccatattccacagcatgaaccggacaaatatgataacaagcaaggcattgggtacagttatctccccaaacaggacgatccgtcacttttatattattcacaggacaagctttctcacattttttacaagcaatacaagcctctgtagcatgaaaaggtttaggagacatcaggaaagtattgaaaaacggacgcaaaaaataggatttagtaaatggaagcgcaccttcatggcaattataatgtttcgtttgaacccttgatgctatctcctcgttaataaagcgtacacgggcaacagcattatgcactttctgggtttccacatcttcatcgtctacatcaaaacctggcaaagaaacataagtattcggcatggtgaccgagtaaccggcagcacaccgccatcccttccgggcaacagcagaagaaaagagttgtgcagtccgacccgtatcatctccacaagtacagacaaagaaaagatattccggcttagtcatcttcaaccgacggataaaacgaagtacaatctccggaggtccccatgcatacacagggaagacaaaacctactttttctccttctcttagtttatactccttattcttatctatttccacagcgatggagaacaattcctcattctgtccttccgccagctgccttgccacccaagctgaattacctgtacctgaaaaataaaatatcatatccgtattatttttataaaaaagaagcgatgctaatctcttgaattaacatcgccttataatgaagccgcaccagtgatgcgatgaaactccgaatgacaggttttgagtgctctcctcctttgtaatccaccggcataaatgctacccgaaggcgtggcccgccattggaagatgaagctatgtctcggttttcagattagtttgatgagtttcccaatccaactaatgcggctcgcttttcatctctttccgtatgacaaatatacgtcctttttatgatataaacaagagtatagcaggatttgtttgttaaaaataataagcaagaaaataactctctgtaattctgcttattgttatttcaaattcttaatgaaacatcacaaagcatccgcaataaaaaagagcaacctcatagagattgctcttttaataaatctttatatcaccgtttacagaagaattaagctacttttgctttagcaacaattgctttgaatgcttccggatggttcatagctaaatcagctaataccttacggttgatttcgataccagctttgtgtaatgcacccatcaatttagaataagacattccttccagacgagccgcagcgttgatacgctgaatccacaaagcgcggaagttacgtttcttgttcttacggtcacggtatgcgtaggtcaaacctttttcccaagtgttttttgctactgtccatacattctttcttgcaccaaaataacctttggtaagacctaaaattttctttcttcttgctctagaagcaacatgatttactgatcttggcatagttttaattctttttgaatgttagcgccactgtttcacacggtgaacttcaagctaaagacattcggttaatactttaaataatacgtttacgctttcgttgtttttagattacttcatgcaaagcaattccttaacttgatccaagttagcattagctactagacctgagtgtacaaggtttcttttctgctttttagtcttcttagtcaaaatatgactgtgaaaagcgtgctttcttttgattttacctgttccggtaagaacgaatctttttttagaaccggagttagtcttgatctttggcatcttgtttttaattttaaattattattcaaatggtggtaacgcactataccggcgcgttacgcactctttttttattcttttgcttctactgcctttttcggattttcctttttagcagtatccatttctgccttcttcggagagcccgctttcttcggagccaaagaaatagtcattctcttaccttccaacaagggcatctgctctacttttgcatattcttccaagtcattcgcaaaacgaagcaataatacttcgccttgttctttgaaaagaatggaacgacctttaaagaacacatatgctttcaccttgtctccgtcctgcaagaatccgatggcatgtttcaacttgaagttgtagtcatgatcatctgtttgaggtccgaaacggatttcttttacgtttacttttacctgtttagccttttgttccttttgacgtttctttaattgataaagaaatttagaataatcaataattctacaaactggaggaacagcattgggtgaaatttcaactaggtcagcctcatgatcctcagccatttttaaagcttgagctatcggataaactgccggttctacatcgtcgcccactatgcggacttctttggcacgaatctgttcattgattctgtgttgcccttttaaactgtcattcttcattaaaaaacttttagttcctgtttgtttcttcttattttaattagtatttctttatcttaacgcaaaagaatacataaaggtttaacaatgtgctcttttgcaaacggctgcaaagttaccatttatttatcatattagaaacttcttcggcaatattttttccgaattcttctattttcatagttcctttgtcgccttcgccctgcttgcggactgcaacttcaccgttttcagcttctttctcacctacaatcaacatataaggaatacgcttcatttcgttgtcacgaatcttacgaccgattttttcattacggtcatccacaatagcacgaacatcgaattttctcagttctgctttcactttttccgcatactcattgaatttctcagaaataggcagaatagctacctgatcaggagtcagccacagcgggaatttaccggcagtgtgctcaatcaatacggcaacaaaacgttccattgatccgaaaggtgcacggtgaatcattaccggacgatgcttttggttatctgaacccatatattccaactggaatcgttcgggcaagttgtagtctacctgaattgttcccaattgccagcgacggccgatagcgtctttcaccataaagtccaatttaggtccatagaatgcagcttcaccatattccactttcgcagtcaggcctttttcttcgcaagcttcaataatggcttgttcggctttttcccaattctcatcactaccaatgtacttttcacggttcaccttgtcacgaagagaaatctgagcttccacattctcaaaattcatagacttgaacacaatgttaatgatatccatcacgcgaaggaattcttccttcacttggtcgggacgacagaacaagtgagcatcatcttgcgtaaaactgcgcacacgggtcagtccgtgcaattcaccactctgttcgtagcggcatacggttccgaattccgcgatacgcaacggcaggtctttataagaacgtggagaattcttataaatcatacagtgatgaggacagttcatcggtttcaggaaatattcttccccttcttcgggtgtatgaataggctggaacgagtccttaccatacttggcgtagtgtccggaagtgatatacaggttcttgttgccaataggcggacacattacttcctgataatcataacgggcctggatacggcgcaagaaatcttgcaaacggatacgcaaggcagtacctttcggtaaccacatgggaagtcccttgcccaccatatcggtaaacatgaacaaatccatttccttacctatcttacgatggtcgcgtttcttggcttcttccagcattaccagatattcgtccagcattttcttcttcgggaaagttataccataaatacgtgtcatctgcttacggtcttcctgccctctccaataagcaccggccacagaaagcagcttgatagctttgataggagcagtagaggtcaagtggggaccacggcaaaggtcggtaaacgcaccttgtgtataagtggtgatgtgtccatcctccagttcggagatcaattcacatttataagtctcacctctttcaccgaatttctttaacgcatcctctttagcaatgctctgacgcaccaatatttctttctttgcagccaactcggccatcttggcctcaatagctggcaaatctgcctccttaatgattgcttcacccgggtctacatcatagtaaaaaccgttttcaatggccggaccgataccaaactgaatgcctggataaagttcttgcaatgcttcggccagcaagtgggcactagtgtgccagaaagcatgtttgccctgttcgtcttcccatttataaagaacgaagtttgcatcttcattgatagggcgagataaatcaatcgtttcaccgttcacaccacaagctaaaacatcttgcgccagccgtgaactgatactttctgcaatctgcagaccagtaactccttcgttatattcgcgaacagagccgtcggggaatgttatctttatcataatcttctatttattttctttcttgaggatgcaaaaataacgaaatctttttgacttatcctctttttagcaaaaaaatgttattcttttcgttccgtaaagcgtttgattatattgtaagcagagaaaagtcccaactcacctgctttactcaggtcctgtataccttgcctgttgttacccaagaaaatatgtgtcaagccgcgattgaaataagcatccgcaaatttaggatccaactggatggctctgtcataatcaacaattgccgcacgatagtctttcaagatagaaagcacattacctctattataataagcatagacaaaatccggagccagctcaatcaccttgtccaaatcgcgctttaccatttcatagtccgcagctttcacagcactcttctctcccggattgactttcaaatcatactctttttccatcttctggtattccagctgcttataacggattaaagcacgattgaaataaaccggaaagaaattaccctcaataataatagcctgattcaaatcttcaatggcacttgcaaaatcctgcaccagataaaagtccaatgaacgtgcaaaacgtttgttcacatcattcggatcagccacaatagcagcagtctgttcgtcaatggatgcaaaatgttttgtagcttgttcttccgtcagaggagcttcctcattagttataatcagacgaccgggaagtactttctgattattcaatgtttcaatgaacttataatagttgacctgtcgtttcacatcatcgtgcttttcataataggtaagcacgaacataggctggggaacaatattcacattcttatcctgcacgcgtccacgatagtcactcttatatttttcttctccctcttcgttgtcggcaaccacaatcttacgatagttgttcatgtttttgtcggacttcttacgggttttattattctctgtattatcggcagtctgcttattaggatctactccgttctgtttatccagttgtgctttcaacactttgaattcatctgcatcagcaccttttacatcccctattttcctacgtgcctgcgctctgtactgatagcccagcaaaaaattgggatattcatttatcaccgtagaataatctttaattgcccctttataatctcctgtctgatccaataacagaccacggttgaaaatagccatcatattgtcgggctccatttcgataacaaaattaaagtcttgaatagcccggttgtcatcgcctacttgtgcacgtaataagccccggttataatggccaatgaaattattgggatcaatatccaatgcaatatcatagtcactcatcgctcctctcaggttattctgatggtaacgggccaaagcacgattgatatagacacctgaattccgggtggacagacggatggcatgatcaaaatcagcttccgcatctttatatctctgttgctgcagacgaaggatagcacggctggcccatgtatctgcatcataacggtctatttcaatcgccttaccaaagtctttttcggcagccaaagtatccttctgcttcaaatccacctcaccacgcatcaaataggcctttgtatatcggggggaaatagcgatcagcttatccagatcattcttcgcccccttataatcttcctgcctgatacggcaaagggccatattatgccatacacctatattctcaggatcaaactccaatgccttggtataatcttctatagctcccgcaaaattattctgttggatccgtgccaatccacgtacctgataagcacttaccacaaacggattccgctcaatagcttctgaacagtcactctccgccccctgaaaatcatccaaatttatcttcgccagacctctatagaaataaggatcagacaaataaggctttgcattaatcacctgattaaaatattgaatcgaaaggacataatcctcaaaataaagcgcattacgccctatcgccatcaccctgtccgtatttatctgtgccgaagctagtacagggaacattattaataatgtatagagtatccgttttatcattttgtatttataaaaatacggttttccccacaaatgcgccacctgtggcgcataaatcaaaatcgcggagttatcattttatagtcttgaccttataggaacaatgcgccttgcccttcaacatggcccccagctttcctttaatcatctgtttgcgtaatgcagacaaatgatcaatgaacatttttccgtccaaatgatcaaattcatgctgcatgacccttgccaaatagccttccacccactcgtcatgttctttcagctcctcatccaaataagtcacatgaatacggtccggacgtttcaccgtttcatggatacctggcaaactcaaacaaccttcttccatgctgacttcttctccacccacttctaaaatatgaggatttatataagcccgacggaaatccttaaattcgggcaattcatcagacatcacatccagatcaatagttacgacacgaataggcaaaccaatttgcggagcagccagacccacaccatctgcacgattcatggtttcaaacatatttgctatcaactctttcaaattagggtaatccggggtaatatcctctgcttctttacgcaacaccggttgtccatacacataaataggtaatatcatttttcttaatctgtttttatttattaaatatatttcttcgactccaaataggactgtaagattatcgtagcactgatttcatcaactaaagctttattctgcctatcttttttcttcaaacctccatccaacatggcttggtgggccaatacggacgtaaatcgctcgtcaacaaactctatcggtatatccggtaattttttccttagttgattgacaaaagggacaatattacgcatattttccgactcttgattattcatttgcttgggatgccctacaatgatgcgttccacaggctctttttccacatatttcagaataaagtccagtagttggtgtgtagggacagtcgttaacccgtttgcaataatttgcaaaacatccgtcacagccacacctgtgcgctttttaccgtaatctatcgctaatattctactcatatagtttgcaaaaatacaaatttattccatacctattttatatataaagattaaaatatgctttttcaactgttttttcaaaagaaacgattcatttcgtttaattttatttgctatttaaaaaatagtacttatttttgcaccgaatatgtggcttaacgtaagggtcgcataatgttaaattgaaacaagtatttgttataaaatgaaaaataagagctcttcaaaaggagttttatatagatgtttgttgtattgtatagctatattgttgcttgttatgattccattaaaaagtttcagtcaatcaacaggagaattaacaacagatagtcttgtaaaaatgggatttgaaaatgtaagatggacagatactcctgaagaaagagtttatgtggttgaaaacagtgcttacaaaattcaagcgttgggtattagaaaggctgtagatatcatacagtcaatgggattacccaaggataaatcttgtaagttgattgttaccaactataatatacctcaggtctcactgacctatcagcctcttgccggtgacacaacagtggtaagtggtgaagattggaaagtcagttatgatataggtgacagttgggacaaggtgaagaaagaaaagaaaaagaacagttcgctgtttaaagtagatatattggtatatccgcagctatactttaagaactatatcattacacagatatatcaggctttattagagtttagcccggcggtagaggtgtcgctttggccaggaatgaaatttaccggacagattgtatttcctgtatacaatgatggatatggagaaacagccggaaaaattcatccaggatatttgacattagcacaaaaatttagattaccatataatatacaaagtacagtaactattggtatgtttgattataatacatatggtgcagatttaaatttgttttatccgtttaaagacgaacgtttttctttggaaggaagaattggctatgttggattcggatattggcatggttttaaatttcgctataatgataaatacactacttattggtctgtagggggaaacttttattggccaaggtataatacacagtttaaattgagagctgaacaatatttattaaaagaaaaaggggtaagatttgaaatgatcagacacttccgctatgccagtataggtttctacgctgtaaaagcagaacatgctaatagtaatggagggtttaaattcatcgtcgcattaccaccttataaatataaaagacataaatatataccaagggtttctacctcattgggtacgggtataacatataatgcaggaaatgaaaaatattattataaaatgccatatagtaatgcaagtgacaatataatgcaacaaaatagttttaatccatattttattaaatcagaattattaaatttttaattttattgagatgaaaaagaaaagttttttgagcggtattggtgctaaattagcattagctgcagtggctttaacaacagtagtgtttacaagctgcgaaaaagaagaatttaatgtagaaccggtagaacttcctaatgcaagtgcaactgttgttgtaactgtttatgatttagctactggtaatattattagtgatttatcaaagactgaaactattacagccgcttctgatggtactattgctgcaacaaccaaaacatatgaagcttctaaagaaggttatttttcaggttcagtaacagtttctattcctgctttagctaaaggacagtatgcttatattcctgctaatatttatttgcaatcatatttgtctgctgccaaagatcctgtcataacagaagatcctgaaactaccatcattgtagatgaacctttgaaagtaacttcttacaccaacactgaggaaaaagctatagataaaaacttgagcctcactgttaaagcaggacaacgtattacgaatatagacgaagtgaaaaactatattgaatcaatagctccttctgctagaaatatgtcttcagctgaagtcaacaaagtattaaacgctttagtgaattcatataattcgggaattcaaaatacaacaatagaacgttcttattctattcctgcattaagcatatttactgtatctcccaaagcaacttcaacaactacaacttgtactattactacaacagttgacggaaaagcatattctatacctagcgttatcattgaaaaagtaggtacatttgttccagaacctactacagaatctattgatcacggtcacggacacggtcatggagataacggcaacgcaggtggtggtgcaggtggaagataataattaatcatctatcggttatttgttcagttattcaccaaaaaatataataaaaatgaaatataaattcttaacactgtcacttttgttggcaggagcttgtgcaactacggttatggcacaagatactaattattatactccgaaatggagtgacaatatttttgtcagtgtaggtggaggtatccacgctattgaaaacgatggtttcaataagctagctcctcacttcagcatctctttgggtaagttaattactcccacatgggggatacgtggtcaggtaaatggtatcacacaacacttgtgtttggataacagttactacgaacacaacaagaactacgtaggagctaacattgacgctatggtaaacttgtcaactctgtttgcaggtgctaatcctagccgtttttttgaagtatatggttttgctggtcctatgctttccgtagctaagtcacagaacgtaacaatcaagaatgatggaacaatggttcccgaaggtgaaagcaaagcaagagcacgtattggtgcatccgccggtgtaggcttgaagttcaacattaacaaatattgggctatcgatgttgaagctcgtggcgccatcgctccttctatctttggtaatatcagtagccaccgtaaagctgaaggaacaggtatgttgacagctggtgtcagctacatctttggtggcaagaagtttgctaaagttgaagaccgtgtagtagaaaaagaagtgatcaaggaagtgatccgcgaagttccgaaagaagtagttaaggaagtgattaaagaagttcctagcgctgcagaagttgctatcttcttcaagatcggtaaagcaaagatcagtccggaaggtatggttaatgtacagttaatggctaaagcaatcaaagctaatcctaacgctaagtacaaaattgcaggtttcgctgataaagctacaggatctgcttcattcaaccagactttgtctgaaaaacgtgctcaggctgtttacgatgcattggttgcagaaggcgtaaaagaaagccagcttgaaaaagttgctatgggtggaacagataacatgtttggtaagaactatttgaaccgcgtagttatcttggaagtaaaataatcattgatacctgataaaactctgatagattaaagaagggagtatcgtaacaaacgatgctccctctttttcttcaactgcttttttgatcacataagcagcaacagcaaataaatcatataacaagaatctacagatcttggctatacaattctggaaacttgaggtagtatttaccgaatcttgtaacaagatatcgggctatacaagcaaaaaactgatacataaaaacaacaggacgtatttagaaaagaacaagagcttttttaaatacatcctgttgtttttaaaaaagctcaagacgattttaaaatattctatcgtatagtgacacagactaatatataagcaacattatacaaacaaaagcatttactatcctcaatagaccagcttcacattgtcaacccaaagtgtatttccaggagaaccgataaaagcccccccatgactggacgaaaattgcagtatcatgtgcgtaggattttcattggcctccgcccatcctatttctttaatcaagacactttctcccttactatttctagtataatccctctctctcaaccccattgtttcatgattataagacggatgcttggttatatcaccatacagcacttcataagtagcaccatttacccaaccatccgaatccttatcatatttcatcaccatagttcctaccctcttcgccgtaatatttccttcagcgtcctccatacgtttttgcaaaaagaaaacagttatcgcacaatcctgccctgccacctgacctttcttgctgaaacctgtcaaccggatacgatctttctcaccagacatctttaccttataatcataacggacagctttgggacgttgagtaaaaggaactccccagttcatgttcttctcagcattcttagttcctgttataggctccagcatatcacctaaataaatggatccggctgccaatacagtaatattcaccatccccaatactttgacgctctctatatgcgtttccaggcgagcacaatatccattgtcccgtttgtctctataaacagaattatttgttttaacaatgcccactaccttagccatcacattagaggttccccaaggagaccctcccatatttttataaggtttgttaccatctatttcctttgtaggacctatctcataaagaagtttggtattgccgcctataacaccggactcatgaaccttacggattatccactgatccatatctccgtattttataggcaccaccttttcctgggcaaagccatacagcggtgctatagccaaaagagcaatgaccgataatctgccataatatttcatacccttagtttttattgttgtttagaaccgacaaagctataaaaaaaagcggcaacttcacagttgccacttttaataaagaaaaatagactatattttcttcttaatttaccaaaaagaagtcattaatatactctatatagtaaccatgccttctggaaatcgtcacggttaggatattttgccttaaactcctcctttgcctgagtagcctgcgcacggtcatcatatgaagatgctataacgcgatacatatttctttcagcattataaaccactttggcattataaccttgaccatccaaatattgtttcaaaccttctgcattcgctttcacaccaaagctaccacatactacgctatatgcttttaagccgtcacctgaaaccaattctactttctcttcgcgaaccggaccggcaacaggagcagttgtcacaggggcagatactaccggagcagcttcaaccggagttgcttctacctgatcagcaggagcttcagccaattcctgttgttttgctttttcataagccttcttgtaagcactttcgctagatttacatgaggaaaatgccaaggctacgcacaatcccatacccaacacaactaattttttcatgattactcaatcttttataaattaatactctagtttaattccattatattggtgcaaaagtagcaatatatcaacagctttcacatcaagaatggagttaaatttagttaatcagagaagaatctccaatttctattcaaaaatagacaaaataaacaacaacattcagttttatttgttagatttgtaaagtacaaaaaacaaaaaaactatgaaaggattaagtattttagctgcattcctaggcggagccgtagttggtgcagcagcaggtattttatttgctcctgaaagcggagaagacactcgtagcaaaattgctgatgctttacgtaaaagaggtatcaaattaagtcgcacagatatggaaaatctggtcgatgaaattgcagccgaggtaaaagaataagcaacgcccacaaaagtgtattgtcattccggacttggatccggaatgacaataatttttaaatcaaaactccacgcatgtttgcaaacgataaaaatatagataatctgcaacaacttctggcagagcttaaaaagtacgcagagttacaaaaggattatgtaaaattacatttagtagaaaaacttactatactgatatcaaccctcatccttgtctttatattattgatattaggtattatcgcacttttctacttgtcatttacattggcctatgtactcgaacctcatgtaggcgggcttatggctagctatggaatcattaccggatgcattattctgctgattctgttaatcgttttattccgcaaacggctgattgtccagcctatggtaaatttccttgccaacctgcttttaaatgacaactgattatgaaagagaatactcctaataaaacgcccatcatcactttggaagtgatagcacaacgaaaagctgagaagttggaagaagtacagcaagctaaaaaagaaatggtacaaaccatacatgaactttttgcgcctgtagaacaaaaaggaggcgtagaaggcattatgcaacatatcaatacaggaatcgccgtttatgacggagtacggaccggtatcaagatcatgcaaagaatcagaggatatttcctgaaaaagaagaaataacttagtattaaccacaacattttatccacatgaaaagacagctactaggtgtggcagcaattttgttgtcaatttccacgtatgcacaggacaatccattatggatgcgttattgtgccatttctccggatggaaccaccatcgcattcacctataaaggtgacatctacacagtaccctctacaggaggcagggccagtcagattacaaccaaccctgcccacgacaccaaacctatctggagtcctgacggaaaaaaaattgctttcgcatcagaccgcatgggaagtatggatatttttgaggtaaacaaggaaggaggtatccccaaaagattaaccacccattcgggtaatgaaacaccggtggcttataaagacgccggacacattctgtttctagccaatataatgccaactgtagaagacgcacaattcccctccggacaattccaacaagtatatgaagttaataccgaaggaggacgccctgccctcttctcttccatgccgatggaagatatcagtatcaatcacacaggtaatactttgctctaccatgacaaaaaaggatatgaagatccttggcgtaaacatcacacttcatccattacccgcgatatttggctgtgttctctgaatggaaaccgtacctttcgcaaacaaactactttcaatggtgaggaccgcactcccgtttgggcttcagatgataaatcattctattatttaagtgaggaaaaaggctcatttaatattttcaaacgtgatattgacggtaatacatccaaacaaatcaccaaccataccaaacatccggtacgcttcctgagtgccgcctccaatggaacattatgctatggatatgatggcgaaatctacacggtaaaagaaggtgccattccgcaaaaagttcagatttccattgtcaccgacaagaacgacaaagatctcatccgccagattaagcgtagcggagcaacagaaatatccctttcacccgatgcaaaagaaattgcttttgtactacgcggagatgtatatgtcacatcaacagaatacagcaccaccaaacaaatcaccaatactccgcaacaggaacgcgatattcacttttctccggacggaagaagtattgtttacgcttccgaaagaaacggattatggcagatttatcaaaccagtctagctaaaaaggaagaaaaacagttcgcttacgcaaccgatatcaaagaggaaagactgaccaattcggatatcacttcattccaacctcaatacagtcctgacggcaaagaagtagcctttcttgaaaaccgtactaccatccgtgttctgaatctgaaatcaaaagctgtacgaaccgtcatggatggcaactatgaatattcatacagcgacggtgaccaatggtatcaatggagtccggacagcaaatggattcttaccaactacataggtattggcggatggaataacaaggatgttgcactggtcaacgcatctggcaacggagaaattcataatctgaccgaaagtggatacagtgacggcaatgccaaatgggtattggatggaaaagccatgatttgggaaagtgaccgcgcaggattccgcagccacggaagctggggcgctgaagcggatatctacatcatgttcttcgacttggacgcatacgaccgtttcagaatgagcaaggaagaacttgctttgctggaggaatcagaaaagaaagacaaagagaagagtgaagagaaaaagaaggctgataataaaaaagataaaaagaaagactccaagaaagaagatgacaagaaggaagtaaaaccactggttttcgaccttgaaaacagccgtgaccgtgtgattcgtctaactgtaaattcttcacgattgggagatgctgtattaactccgaagggtgacaaactatattatcaagcagccttcgaaagcggatatgatttatgggaacacgatcttaaagaaaacaagactaaaatcgtcatgaaaaaagtcggtggcggagccctgcttcctgataagaaaggcgagaatctgttcctttgcagccaaggtggtatcaagaaagttactgtcagcagtggtgaaaccaaacctgtagaattcgaagctttcttcgactaccaaccctatggtgaacgcgaatatattttcgatcatgtatggcaacaagtagaagataaattctacgtaaaagatctgcacggagtagattggaaaggctatcacgaagcatacgcacgctttcttccatacatcaataacaattatgattttcaggaaatgctgagtgaaatgctgggtgagttaaacggttcacacaccggagcacgttactactcaaacggtcctacactatccacagcgaccctaggagcattctatgacgaaacttatgatggtgacgggctaaaaattaaagaaatattagcaaaaggtccatttgccgtgaaaaaaacggatgttactcctggttgcatcatcgagaaaattgacggcaaacctatcgtaaaaggacaagactacttcccgctactggaaggcaaagccggaagaagagtgttactggccatatataatccggctaccggcaaacgttttgatatcaccatcaaagctatcagcacgggcgaacaaagtaacttgctgtataaacgttgggtagaacgttgccgcaatatagtcgataaattatccgaaggccgcataggctatgtacacgtaaaaggtatggacagtcaaagtttccgcgaagtatatagtgaagtattgggacgctgccgcaacaaagaagctattattgtagacacacgccacaatggaggcggctggctacatgatgacttggccactttattaagcggcaaggaatatcagcgtttcgttccacgcggacaatacataggcagcgacccattcaataaatggctcaagccatcctgcgtattggtatgcgaggacaattacagtaacgcacatggcttcccatgggtttacaaggaattaaagataggcaaactgattggcgcaccggttccgggcacaatgactgccgtatggtgggaaaaccaaatcgatccgagcattgtgttcggtattcctcaggtgggttgcatggatatgcgtggacaatatgcagaaaatcaccaactttctccagacattgaagtttataatactccagaaaaggcattggtaggtgaagaccagcagttggaagcagccgtacaagaaatgctgaaaacaataggggaaaagaaataaaacaatcccatcctgataaaaaagaaaaaagacagatgcgaagatattttcgcatgcctgtcttttttcttgctctattcacatccgtccaagacaaagatggctcatccaacctttataaagcgatcatccgatgaatataagacatacgctttatatccgtcggacgatattatcaaaaggaaacaatatgaaatagttcttgatcagaagaaagattctcaagcctccttcgctctttttttccaaagacgagtcatatcttccaaagtctttccttttgtttcaggaaccatcttccatacaaacagagctgcaagcacacaaatcacgccataaagcccataggcaaacaccggactgaattcatacatggcaggaaaagtggaagagaccagataattgaatatccattggaaagctacagcaatagccactgccttgccgcggatagtattcggaaatatctctgcaatcaacacccagcagataggtccccatgacatcataaaaaatgcagcataaacaatgatggaaagaacaggaagaatacctcccacctgaaactcatcacaaaatgcaacacagaatgcacctacagccataccaatagaaccaacaatcaacaagggtttacgtcccatcttctctacggtaaagatagcaaccaatgtaaagagaatattaactacccccattaccacagtctgcatcataccatcaccaccgccaccgattttctcaaaaatacgcggtgcataataaagcacagcattaataccgatagcttgctgaaatacagaaagcaagataccgactacaataactgtcaacccgtatgtaagcagtttctctgttttctcggaagtcacagcctttatttcagacaaaatagttttagccttatctgttccatttactttttcaagtacagaaaacgctttatcatcctgatgggtcatagccaaatagcgcggagtttcaggaaccaaaaacaataaaatgccaaataatgcagccggaaccgcttctgaaccaaacatatatctccaaccatcggaaacaagcacttcatccggcataccatctttaatcatataattgacaaaatagactaccaacatgccaaaaataatagcaaactgattacaggaaaccaatttaccacgaatttcggaaggggcaatttcggcaatgtacatcggacaaacagcagaggcaagtcctacaccgattcccccgatgatacgataaaagttaaaagcaaggatcaatgcaaacgaagtatctcctttagagaaaaataaaaattcgggataataagagcctaaagcagacagaaagaacaataaagcagccagacgcaacgaattacgacgtcctaaccccgaagcaaaataaccggaaaaagcactaccaatgacacaacctatcaatgcactggaagcagtcacgccatgccagaaagcatctaatcccaaatgtttttgcagagcctgctccgctcccgaaataacagctgtatcataaccgaaaagtaaaccgccgagaatggctataaacaccactcccatcagatagaaattgtttttcttgtttttcataataaaagaattataatagttttcgtaataaatacaataacaaagctgtgcgaaattaatcattaatacgtaattctattataattctccaaccattttaaatctttttcacatcaaggataaacaagattatttcgtctgaactgttctatgtcttccttttttaatcctatcttatccaatgacttaggaagattatgatcattaagataataacgcggacgaatgagatattgtctatttgctaccgataggctatctgccctataaggtgtctgtatccctgccaaattcagcatggtatgaaacacagaagcatttcctgctaccggtttttcacggttctgcaatatagcttcatgtacttccacattctcttctctatatgctttggacaaccaaattaaaaatggtacatgcagttgataataagacgggaccggggatgcatgtaaaaataattttcgattatcatcaaaaatatcctctccatgatccgaagtataaagcatagccgaaaaagagttcattttctgcaataaagtgatcaaagaagccagaaaaccatctgtataacggatagtgttatcgtatgcattcatcaaatactctttattctcatatttggcgtctgtcagattatccggtttaaagacagacatggattcgggataacgttctttataattaaaatgtgatccataggcatgcagcacgataaataatttttgatgacctgcctttagctcctcttctactagaaacaatagttcgtcatccgaaatattggctcctttcggagtgtctttcttgataaacttccaatcatctgcctccatccccaaaaaatcaataaaagaatggttaggaagctggttcgaaaaaaaggctgtatgaaatcctgcctccttgaaagcggtaatgattcctttctgtctataaagacagtcataatcctcagccgaagctgccgaaagcaacataggcacacttttatgagtagtattagactgggtaagcacatccgtgaaagttaccaacccctccattttatcaagtaatggagtggtattcctttcataaccataaagtccgaaattacaggcacgggccgtttcccctatcaccaagacataaacttcccggctgtctttatcatgtgcggcactggcattaaaagtaaaatcccttgaagtttccgcatatccggcagtttcgcccgcacgttctgcagccaatactaaattataacatacattagccggatacatttcaatctttacttgataatcacgttgcgtcgcatagcagataacagtcaataacactcctgcaacaatgcctgccaaggcatacttacgttgagaacgaataaaagaatattccaactgattacctcggacccatgagaaacctcccaagaccaaagcaggaatgtaaacaacaaaaacaccaattacagccggcagtaaattatccaacagttccatcacctccccggaattagtagttgtcagattcaggaacatatctactgcaatgatagaacgcccgaacaggtatagcaataccaattggaatgccgcaaagaaaacaaatggaaataagatccaaatagtctttccaggtttacgccccaatgtcataatcaaccaataaaccgataccggcagaatgacattacaaatacgtgccaaaagtgtcatttgttgttctgtaaaaaacaatgccacattgggaatggccaagacaacgatgaacagaacgaacaatcgttgtggctcacaacaccactgaataaattctttaaaatgcttcatttatattaaaaataaaaccagactgtccattttttccaaatccatagtccagacgaacatttacattctttttaaactcccaacgataacctattccataattaggcaacactctgtccatgcgcaaagcactgaacttattgaatacagttccggcccctatccaaactacaacaccattacgtttccatacatgctgacgcaattccacctgcccctctattttatgcttgtcacgatagcgcccttcgtaataaccacgcatggaatacgaatttcccaacagcgccatcatagcccacgacggattaccgaaattaaaagtaccgcgtaattctcctgccaacaatcctccttcccatacaggatgataataactggtacgcaaatccgtagtactgaatgcataatcgtttcctaaaaacttaggacggaaacattgggtaatattcaaataatatcccttatggggattagtcaacacatcgcgcgaatcatatgccaaagaaaggcccactccataattagcagtagtaaggttcattccctccagtaatccggggcgttccatattcttaccatgcacataatcataagatgccataggacctatatataaattatccgctatccgaaacaaaaaactagctttaatttgtgcttgccagcgatctaaatcagattcattggcatctacattacccatatcgtaccctattccccaaaacttggaaggaaaggaataaaaataaagagtataatccagccggtatttgtcctgcggaaagatatgagttccgcgtatccccaacatatagaagccaacagtggaaacatctccaaataaagatacattggacgggggaagaagcatgtcacttctatcagcacgataaagccccgctgccaccagtccaagccccagtttggtatccgtactgtaatgtggtccgccaataatactaaaatcaaatttcttatgattcttatctttattagcatcattaaaatagtccagaaatcttttgaaaaaagtccttttctgtactgtgctgtctttgtgttgcattgtcgtatcttcaggcaaataaaacagaccgccctcttgcgtgactgccaaagccgcatctgccatacatataaagattacgatcaaaaatgatattttcttcattgtaacctgttattttttccactgttaaaacaagctttacagtaaacataaactgataaaaacaaataaagcagattgggatacaaagatagccaaacctgctttattgtgactttttttataataagaatctggtctgaatttacctatttctgtcctaaataccttataccggtcgcttttctgtaatcagccaacgcaatcttctgctcataataagattggataaggtttgtatatgcctgtatccatgtcagctgtgcagaaagcacatccaaaatagtcaacttaccttcagtataactaaaagtgttcaaatccaaattctcttctgccagtttgcagttctcctcggcaatacttatctgacgggtattctctgtcagactagtccacgccttcgccacttctttgcttatttggtcttgcttatcttgcaatgcatactgcttgcccaataaaatagccttctgtgcagccgtcgatttaaagcgggctccccaatggaaaatcggcaatttaatagaggcatacacattactattaaacatagtttcgcccgaaatgttcaacatctgtgttccccatgtctctttaaaaccgatagaaagagaagggttgtacttggcggcagccagacttacctgtcttttctgataatccacatccaattgggagatagcataatcgggacgcacattcaaggctgtttccgctccaacaaaggcaggcataggcaatatggtagaaatagaatccgtcaaatccatttcagccagcggttccaatcccatcagtacattcatattctgcaaggcgacctgataagactgatagctgctggaacgttgcaattcagcctctttcaaacgagtctgcatctgaatgagatccgtcttgctgatatagccatcatcgtacttatcttgcagcactttggtcaactgctcaataatctgtacatactggcacatcgtttcatacatttctttttgtgcggctgttccccaataactggcttcagcggcatagataatattatccgttgtcaaatccaccgacttatccgccatctgagtttgtatttgggaagccttataattgtgatagatactgccaccggcataaataggttgtgatacccctacttcggcactgtatgaatcgtgctccataggaacagccattccgccaaaatccatctcgtatttgttaatacgatactgatagcttcccgttgcatcaacagccggaaagaaagcggtttttgccgctttcatagccttctgcatagctgtacgttgcgccacactctgttttaaggtttggctataatccagtaccttttgttcaaaggtagaataatccacgacagtctgagccgaaagtgtaccggtcatacaagccatacttataatatagatcatcttagttttcattatctgtctgctctaattttaaagaaaatacaataagttaccggaagaacaaaaatggtcagtaccgttgatacgaacaaaccacccataatggtagccgccatacctgcaaacatggcatcgcccaacaatggaagcatacccagaatagtagttccggaagccatggtcaccggaacgatacgcgtcttggtagcctcgaccacggcaggcacagcaccctttccatccttcaactgaagtccgatttcatcgaccagcacaatggcgttcttgatattcataccaatcaatcccaacagaccgaggatggcaaagaagtccaatgacttaccaaacaaaagcaatccccataccacaccaataaacaccagcggcaacataagcataatcaataccggcttgcggtagttgctggggaaaagaaacagcagaaccacataaatcaacaggaaggtcagcggaatattcttcgccaatgcagcgttactcacatcctgtgtttcctgctcgccgaaatatttcattttatacccttcgggcaaccgcatctgctcttgtacggcagtgagcacctgtttaaacgcagccatcgtattggctccacgtctaggttcacattgcatcatcatacaacgctcgcggttaaagcggcggactacattataatcataacccaaagcaaaattatcgatcacctgttccactttcacggaatttcctttcgtactgaatacaggcacacttttcacatcattcaagttcattttttccacatcctcatctttcaacagaataggcaaggaaacatccccctcacgatattctcccaaaggcaaaccattggtagccgtacggaatgaattagcaacctgctgacgggtaattcccaagcgtaaacctttctgttgagagaacatcggtttccacacaggcaccttatctccccaattagaacggatatccgtcaccatatcacactggcgggctattttcttcgccctttcaaccaatgcggtcaatgtatcgggattctcaccgataaaaccgatctcaatagcagcttcaggcaccggagacaaagcaaaaagtgccgaacgggtaatgatattgggaaagttctgggtcatgtgctcataaaactgctgttctacttcggctgcatcttcggggtctttagtttccaccatcacattagcatagttagacttcggtccaaaagaagaacttgccaaatagtaacgcaacggagtaccacccaatgtcaccgaatatgatttaactttctcatgattcttcaaataaccctccaccttcatcacatcctgatctaccgcatgaatactgaatccctcagggaataccagatcagcacgaaaataaggcttattcattttcggaaaaaaactctgaggcataacagccataataaccaaagaaagcaccaaagtcacaaagacggtggtcaatgtcacaaaacggcgtttaatcagcaaggtcagaaacttctcgaatttatgatagagtttagtatcatacggatctttcattgcaccgccgggaacagcttctttcaaaataaaattaccaaaagtcgtagtctggcataaagccagaatccaactcaatcccagtgacacagccaatacaacaaatagcggtttcacaatctcagccacggatgccggtgccagatacaaaggcaagaaagagcagatagcaataaaagtagcgcccagcaatgcccactgcggcttgatggccccctctatcaatgactgataacgtgattttccgcgcttgatacctatttgcgcattatctgtcaccacaatggcattatccaccagcatacccatggcgataataaatgccgccaaagaagtacggttcaatcctactccccacatcaacataataagcaaagtaccacctactgagaaaagtaacgaactacctatcagcataccggcacgcgatcccatcaccacaaagataatcaggataacaataaccaatgattctatcaaattcaggataaagccattattcgcctcatcggcaatcttatcctcaggataaagggaggcaagttcaataccgataggcaacaattgctctatttccgccaacctttcgtccactgctttacccacagctaccacattatcctttgctccactggccacacctataccaatagcacgtttaccattgacccgcatcaaggttgaaggcggatcatagtatccacgctccactgttgcaatatcccccaaacggacttcccgtccgtccttactgataatcaactgattttctatatcttccagactggtataagttccttccgtacgcaagcgcaactgataaatttctgtcgctatatctcccgtattcacctgtatattctgcttctgcaagatgcccataattgaagtgggatcaatgcccagtgccgaaagtttggaggtggatatcttgacattgatcacttctgtctgttccccatacaacatcactttctgcactccctcaatcggagtcaactgggtacggatacgctgggcccagtcacgcaaatcagtatacgagaatccctcatcagcggtcaaagcataataaatgccatacacatcaccaaagtcatcattcactgtaatggtagacgccccactgggcaatttgggttgtatattcgccactttacgacgtaattcatcccatttcacaggcatataatccggatcaatcgtaggctgaagttcaatagaaatcttggacagtccgaaataagattccgatttaatctgatatacatctgtcatggactgaatttcacgttcaatcggttccgtaatcagtttctccacttcatgtgggttcgctcccggatactgggtaaccaataccgcagtctttatcacaaaaggcgcatcttctttcttaggcagcttgaagaaggagattactccacctatcagcaaaatagccaaaaagaaatagataaccttccggttctccaaagaatattttggaatattcatgatatgctttctccttttttattctgttaatatttttacttgctggccatccacaagataagaggctccggcagaaacgacctgttcacccgctttcacatctccggtaacaatcaagtcattacgtccaacaatagtacccttatcgttgactttgcgttgttccactttctgtgtggatggattataaacaaatacttttttactattcaatgtattgtcaaacactacagccgacaaaggtactgtaatcccttcttttaccacatcattctcaatattggcaataacacgacatgagaaccccaccgataccttgtattttttcaaatcaaattccggatcatcaatgtaaaggaatacaggaactcctgccccatcgggagaagcctctacatactcctttacttttgcttgaaataattttcctttataggcatcaaattctacgtaaatagtagaaggagaagttacataagaaatattcgtttcggggatagtgaactccacttgcaatttagccggattaatcaaacacactactccttgtcctggttgtacacgctgatagttttcaacgtattttttttggatgaaaccatcaaatggagcgcgtagctttgtgtcattcaatgtgttttgcgcatcttcaaatgccgatttggcattggtatacgaagcttgggtcgtttcaaattcttgcatggaaatggcgttcttagccaatagtttctccgcgcgttgcatctgtgatgccgccttttgaaatgaagccctcttagcgtcataatccaatttgtaatctgtcggatcaatttcggccactacctgtcctttctttacccgctgtccttcgagtacattcattgctaccagcggaccggacattttaaaggccaagtcactgaactgatcaggcgacacaacacctgaatacgatttttcgatcctgcttaacgaggtcacttccgccaatttcacgggacggggaccgcgttcttgtgcaggttgctgtccgcaagaacagaacactgctgcaatcattgccatgatagacaaatttttacctttcatactgttaatcttcactattagtttccgctgcaaagttctcataattattaaaggcgtacaagtgctaacagtaagatatattagtctatttttaagcattttctttgttatctgctttaactgtcctatatttgtggtgcataatcaaaatcttctttatttttatgaagtatatagatgacattaacctatttaaatcaaataaggatttcgttgcagaaattgacatgacaggatcattaggccgtatttaccactacccgcaacgaatggaaggatgcttgttccttctgtgcctgcgaggtgaatgtgacataacgatccatctgtctgaacacaagatacaaaagaacgacattgtcactattttgccagaaacctttgtacatgtccaccggcaaagtcccgactgccgtctgtacctgatagggttcaacaaagagttgctgaatggaataaacctcttcaattccaccatgaactatctttcagccctgattgacacgcccattattcctctgcgtcccgaaataaccgagttgtttcaagactattttatgttgctgataaaaatgaaacgtatgggagccaagcccaataaagacttaatcagcaccatgctgctcactatattgcatggtgtaggcagcattcatcagaacaccaatgtaaccacacgtactttcaatcgtggagaagaaattgtaaaacgtctggtccaatatatcatcaaacattatacgaaagaacggagtgtagctttttatgccgatctgcttcatatatcccctcagcacctcagcactactgtcaataagattacgggaaaaactgttacagatatcatcgccaaactagtgataacagatgcggaagccaaactaaaatccaccgatcttactattcaggagatagcctattcacttaatttcccagatatctcattctttgggaaatattttaaaagatatacaggaatgtcaccgaaacagtatagggaaaacggatagtgaaaacagactcagcccacgttagtacgtgtaaggtcatacatcagtacgtataagcctacatatactaacgtataagcttatacatactaacatataaaaacacatgtccaaagtctcttacaccataaaagttataagtttttcggcttataaatagcgttccaccaagtcgcatcgtcctgcaaccatttggcaaaccaggcaaagattgtattctgccactggatcctcttgccatagtctacaatatgatgatcttgccccgttaccgccacaaaagctgtttcgcgtcccagcaatttcagtgctgtaaacatctgaatactctctcccaccggtacattcacatccgcatcaccatgcaggaacagcaaaggcgtatgtatcttgtccgcattgaacaacgggctttgttttacaaaaagatcaggattgctccacggataactatccgccatggaaacttcactatacgaatatccccaatatccttccccccaataactggtatggtcactgataccggcatgagagatggccgctgcaaaaatatcggtctgtgtttgcaggtattgtgtcataaagccgccataggacgcacctatacagcctattttcttgtcattgacaaaagcatgttctttacaaaacagctttgtaccttctataatatcctgtgccaccccttccccggctgtattgacgtggcgggcagagaattcctgtccgaaaccggtagcaccgctaggttctatcacatacaccacatagcccaatgccgcgtatgcatgatgcggataacggctttcaaaattacggctgaccggactgcacccaccataataattcacaatcataggatatttccggttagcgtcaaaatgaggcggcaggtaataacggccgtaaatggtatcaccacgcgaattggtaaaactccaagccttgcattcgcccagctccacatctttcaagatgtccttacttaagtcttccaacaaagatgatttcatctttttggtattcatggtgtacaaacggtcggaatttgaggcgctttgtccataataggccataaccggagcattttgcgccaatgagaatgaattgaccaaatcttctgaaacctccagttgcagaattttcccatcagcgggattcatccggtacaaactgtaacagtcacggttctcggccgtgaaatatatttgcccgtcgaccttattccacacggcacgctgtacgctgggattaaaatctttcgtcagcggagtgaccctcttatcagctatattcagcaaataaagctgaccgtccgtcatactcggagtctgcccctcctttacatttttccctattccacccagcgattcaggcgagccggataccaatacctgcgttccgtcaggtgaaaaacgggctccactgataaaaccatctttatctatcagcaattccgcctgtaaagtctgcatatccaaccgatatagtgagaataaagtagtaggacgcttggtcagacggctctgactggtcatcatcaaaagataccggccgtcattggaaatatcggcagcccagacattgtgataaccgaaagtcagtggctgcaacaaaccggtcttcaaatcatatttagccagataagaacggttacgccatcccggctggcggtcatccggctccagtacctcataaatttctttacgttctttcggtccttcctgggtcatggtgaaaagcaggtagtcttccgtaggtgcgaactggaaatacccgtcaggtaatttattcaccagcacggcctccactccggtaagtggatccacaactatcagctgcctgccatccactcctgtacgggtataataataacggttagaacgaggcatccattgcatattctcagtacgctccgccaaaaccttaccgctggcaagttcagtaatacgcgtactgccggccgaccggccacctacacaagtcgtacgataattagtaatcagatatctgccatcaggagaaagtcctactccggcaaaacgagttccatgcaacacatccgctaaagtatatagctttttgttatcttgcttaagtgaaatgcttccctcttgatccgtatccacactcactttcaaagaatctgttttccctgtttcagaaagatatttaacaactacagaatgggtggccggctccaaagcgagttcagtcccttcctgctttttcccatctacataaagttggtatttttccagaccgtcaatcttcaacttggccgtagcataacgagtattctccaacacaaagcccaccatgtgcaaggcatatcccgagtcacttcccggcaaaactccgcctgtaaataaagttccctgctgcaatacgtccacagaaagatgagtatctaacaaacgtccggatacaaaagtctttgaattcacatccacgctgtctacctgaaaaggagcctgtacaatgtagggtccggcataacggaaagtagtaatgtcaatcgtttcagcacctgccatcacagcccaggcaagagcacaagacaataagatttgtttcttcatatttctaacaatttgtgttacacaaagatacgaaatataaaagaaacaaaaacctttttctacgaatttcaatgcttcctacaacatattatttcacctctcccggcagatagcgcaactgcaaatactgttctcccggtttcagataccccccttcgaacatttctttcctgatccggtaaactgccacccttttcaataagtaattttctaccttcatcggctgctttttacaccaagaaagcactttcagacttccatcggcatgaacatccgcatagacttttaccgttcttatcggagtcccgtccgctatcttacgtcctcttttataatccacccacaaaatagctttcgctttttccccctcacatgtcccagcatacttatccgtttcggatgcggtggaaggtgaagaagttcccttacaacctacaaccgcacataaaatcaaaagatataaaatatagccccctcgtattttcatatcaatcggattagtcttttatctcttctataggagtaatatcctctatttcaggcatacccggttctttcttctgacggaagcggatgatgtttatcaaatcggacagtccgtatacaatgctgctcactcccagaatgatgaatggaacagccgccgccgtaaatggattaaataataccacaatacctgcaatcagcaccaacacaggtatcacaaagaaacctcccggtaccaccgtccaactacgcgcagcagacaaattcacaatctgactgattcccgccagtaccaaaacagcacccagcacatacatcagaataccgacaaaaaatgccggcataatcatcaaccataatccgaacaaaaggctaccaagcccggcaatagggaaactgctgccatcctgcttgccacgaatcaaatacccaaatacagaaaagagtcccggtactagaaacaggacaccgattgtaataaccagataaagaatggcagcttcaggccatgccaccagcaacacaccgatgaccaatgcacagatacatctgattatagaataattcattgttttcatattcaatcatgtctaattggttaatgaagcgaatatactgattatttctgagaagacagatgcaaaatggatattaatttttcagacagaagaacaaaagaagaaagccggaacagattttcctgtcataagcttagaactacattctattgttctatagactttagcaaacagaatattctaccgactattccaatatgttctttcgtacccatgcctgaagatcatccttttatcatatggcaaatcactctatctgttctgtttcaggcagactttgttcattctcgtcctcatcgatcaaaatagcccaaaagagccaccataacagcaatcctgccaacaacacggcacctatccttatccaaagtttacgtttcatacacttcattttaatgatttattaactgatgtattaaaaccattccgccacccgaaatgttcatttataaaaccaatttaaagtaataagattatgaataatggaaaattctttgccggactggcactaggagcgctggtcggcagtgcattaagttgttttgcgcacagcaacagaggccgcaaattgagaagagacgtgtatgatgccattcaggacttacaagaagatgcaaaagacctggctcatcatgcaaaacataaagcagaacaagtaagcagtgaagtagccggaaaagtaggtgagaaagtggaagaagtgaaagggaaaatacacgaggctgcaaataaataaaaaaaaagtaagtttttctttggagtttaaaacaaaacgcttacatttgccccaaaataaaaacagattttatgaatagaatcatggtaaatacatattggtggcgtttcttacaactaaacaagtcgtaagggaaccagaccatgtatatatacctgacattctaataaggatattcaaactgaaggcctgtcgtacttacgacaggccttttttcgttagtgcaattaacaatcaaaatttaatatagaacgacaatgaaaacttatcaggtaaacaaagaaggttattatggcgaatttggcggggcctatattcccgaaatccttcatcgctgtgtggaagagttaaaaaatgcctattccaaagtattggaaagtgaaggattcaaaaaagaattccaccagttactacacgactatgtgggacgcccttcacctctatacctggcaaaccggctaagcgaacaatacggctgtaaaatctacctgaaacgtgaagatttgaaccacaccggagcacacaaaatcaacaatgccatcggccaggtgttactggcaaaacgtatggggaaaaaacgtatcattgcagaaaccggagctggacagcatggtgtggccaccgccacggtatgcgctttgatgaacatgcaatgcattgtttacatgggcaagaccgatgtagaacgccagcatatcaatgtagaaaagatgaaaatgctgggagccgaagtccgcccggtcacttccggcaacatgacactgaaagatgctacaaacgaagccatccgcgattggtgttgccaccctgcagatacttactatgtcatcggctctaccgtaggccctcatccctaccctgatatggtggcacgtctgcaatccgttatcagcgaagaaatcaaaaagcagctgaaagaacaggaaggaagggaatatcccgattacttgatggcttgtgtaggaggaggaagcaatgcggcaggaaccatttatcactatatagatgatgaacgtgtgcagattgtcctggccgaagcaggaggcaaaggcatagacaccggtttctcggccgctaccatccaactggggaaaatgggaattatccacggagcaaagaccttggttatccaaaacgaggacggacaaatagaggaaccttactccatctctgccggtctggattatccgggcataggccccatgcatgccaatctagccaaacagcaacgcgctttggtactcgccataaacgatgatgaagccatccgtgccgcatttgaactgacccggctggaaggtattattcctgcattggaatcggctcatgcattgggagcactggacaaaatgagattcaagccaacggatatagtggttctcaccgtatcaggacgcggagataaggatattgaaacctacttgaaagaatccagcacaagggcctccctgcaataacacatagaaacccacgagagtaaaaatcttatacggacaactataaacagaaaagaaacaatgaaaacttttacctataccacccgatacaaaaccatactgggtgacctacatacaccggtcagtacttatctgaaagtacgcgacattttcccacagagtgcgctgatggaaagttccgactatcatggaagtgagaacaaccgttctttcatcggactgaatcctgtagccagcatcggaatcaaccatggcatagccactgccacctaccctgacggcagcatggaagaacatcccatcaccgaacatttccgggcagaccatgcgatctccgattttctgaatcgtttcaaggtaagcggagaatacaacaactactgcggactgtatggttataccacgttcaatgccgtacgctacttcgaacatatcaatgtaaaagacagccgtgaccctaagaacgatgctccggatatgttgtatatcttatataaatacctgatcgtcttcaatgacttccgcaatgaaatgttattactggaaatgttgcaggacggtgaggacagccatctggattatgtggaaaaagcaatccacaaccgtaactataccacttacgacttccgtgccgtgggcgaaactaccagcaccctgaccgatgaagagcataaggcgaacatccgcaaaggcattgcccactgtatgcgcggtgatgttttccaaatcgtcctttcacgccgttttatccaacgttacgaaggagatgatttcaaactttaccgtgctttacgcagcatcaacccgtccccctacttattttacttcgatttcgggggcttccgtattttcggttcctctcccgagacccactgtaaaatagaaaacggacgtgccaccatcgaccctatcgccggaaccacccgccgcaacggagacaagaaaatagatgctgaactcaccgccaacctattggctgatcccaaagaaaatgcagaacacgtaatgctggtagatctggcacgcaatgacttgagccgcaattgtcacgatgtacaagtagaattttacaaagaagctcaatattacagccacgtcattcatctggtaagccgggtcagtggcgaactgaaccccaaagccaatcccatcaaagcatttattgatactttcccggccggaactctgagtggcgctccgaaggtaaaagccatgcaactgatcagcgaatacgaacctcacagccgtggagcctatggaggttgcatcggatttatcgggctgaacggcacattgaaccaagctattaccattcgtacattcgtcagccgcaacaacgaactatggtttcaagccggtggcggcatcgtagctaagagcaatgaagagtacgagttacaagaagtaaacaacaaactgggagcacttaaaaaagcaatcatcctggcagaacaaatgtaaaaacgaatcatcatgaaaacagtaattatagacaactatgactcatttacctacaacttgagtcatttggtaaaagaactgggagccgaagttaccgtattacgtaacgatgctttccaactggaagaattggaaaaattcgataaaatcattctttcacccggtcccggtattccatcagaagcaggcctgctgctcgaagtaattaaaagatatgccggcaagaaaccgattctgggtgtatgcttgggagaacaggccataggagaagcttttggcggcaaactgaccaatctgagcgaagtatttcatggcgtacagacccccatctcaattaaaaagaatcaattaaaagacaaaggagagaaaaccgattacattttcaacggactgccggatgaagtgccggtaggacgttatcactcatgggtggtagatacggacggtttccctgagtgccttgaaataaccgcagtaagccgggaaggtctcgttatggcattgaaacataaagaatacgatatccacggcatccagtttcatcccgaatccgtactaacccccgatggtaaaaccatgatagccaactttctaaacgcataaaccaaaccgtacataataaatatgaaagctatattatcccgcctcttcaatcacgaggaactgacccgaaaagaagcaaagaatttgctgctcaacataacccggggaatgtataacgacgcacagatagccgctctgctgaccgttttccaaatgcgcggcatcaaagtagaagaattgataggtttccgtgaagcattgctcaccacccgcatacctatagacttttccgcttacacccctattgatattgtaggtacaggcggtgatggaaaaaataccttcaacatctctacttgcgcctgcttcattgtagcgggagccggatatcatgttgccaaacatggcaactatggcgcgacttccgtcagcggagccagcaatgtcatcgaacaacacggcgtaaaattcactaataatccggataagctgacccgttctatggaagaatgtggaatggtctatatgcatgcccagttgttcaatcctgccatgaaaagtgtaggccctgtccgcaaagcactgcaagtacgtaccatattcaacctgctaggtccgctggttaatccatgtcttccggcttaccaacttctaggggtcgccgatctgccgcaaatgcgcctttacaccaacgtattccagaaactaggcattggctttgccgtagtaaacaacctggacggttacgacgaaatctcactgaccgatgaattcaaagtgatgaccaatcgctacgaaaccatctacaagccatctgaactgggtttctcccttgccagacaagaagagctttatggtgggaacactcccgaagaagcgtcaaaaatcttcaataacgtactggagaacaaagccaccaaagcccagacagactgtgtgctgattaatgcttcttttgccatacaagccatggaaccggccaaaccgatagaagaatgcgtggccatcgcccgtgaatcattggaaagcggaaaagcattgaatacattgaaaaaatttgtggaactgaacagttgattacacacccagtattccactaccaaacgcctcatacaatgacagatatattaacagaaatcatcgcctgcaagcagatcgagatcgaactgcaaaaggctgccatcagcaaagaaatgctgataaacaattgtaacgaacccatgccacgtatcagtatgcgtgccagtcttgcctcttctccttacggcatcatctccgagttcaagcgtcgctccccctccaaaggatggataaaagaagacgcacaggcagatactattcctcccgcttacgaggcggccggagcctccgcactttccatcctcaccgatgaaaaatacttcggcggcactctgaaagatatccgttcggcacgcccccacgtgcaacttcccattctaaggaaagatttcattatagatgaataccaactttatcaggcacgcatcgtaggagcggacgctatccttcttatagccgccgctttgaagaaagagcaatgcaaagccctggccctcaaagcccatgaacttgaactggaagtcctgctggaaatccacaacgagcaagaactggaatatatagacgagaacattgacatggtaggagtcaacaaccgtaatctgggaagcttccacacagaggtggaaaactctttccgcctggcggaaaaactacccgaagaaatgctccggatctctgaaagcggcatctccagccccgaaacagttaaacaactccgagctgccggcttccgaggcttcctgataggggaaaactttatgaaaacacccgcacctggagaagccttaaaagaatttataaccaaactagagaaatgttaggatgcaacaacaatgattatcaaggtatgcggtatgcgcgagcccgaaaacatacgcgccatagagcaagccggagcagactggatgggattcatcttcttcccccagtctgtccgccacgtatcacatcgtccggaatacctgccggaacaatgccgccggatcggagtcttcgtcaacgaaagcagcgaaaacatcctgctgaaagcacaggaattcggtctgcaccatatccagttgcatggcagggaaacaccggaacaatgccgcaaattaaaagccgccggattaggaatcattaaggtgttttccattgcacgggaaattgacctgcgacccgtcggctgttatgagggcatttgcgattactttcttttcgacactgcctgttccggatatggcggttccggcaaaactttcaactggaatatcctgcaagcctatcggggaaaaacgcctttcctgctgagtggcggcctccgtcccggcagcctttcctctctgttgcagttcaaacatgaacagtgggcaggcatcgacctgaacagcggattcgagactgctccggctctgaaagacgccgccgccgtccacacatttataaaccaattaaaacaaaaaatacaatgaacagaatcaaccagttattcagtatcaagcaaaaagacatcctctctatttatttttgcgcaggctttcctactttagaaggtacggcaagcaccatcaaagtcctggaaaaaaaagggattaacatgattgaaatcggcattcctttcagtgacccgatggctgacggtcccgttatccagcacgccgccacccgcgccttgaaaaacggcatgacactgaaacttcttttcgaccaactgaaagatatccgtaaagaagtacagattccgctggtgttgatgggatatctcaatcccatcatgcaatatggattcaaggatttctgccgcacttgccgggagacgggaatcgacggggtgattatccccgacttgcctttcaaagattatatggaggaatatcgttccatagccgaggaacaggatgtgagaatcatcatgctcatcactccggaaaccagcgaagaacgtatccgcctgattgatgaacacaccgacggttttatctatatggtatcttccgccgctatcaccggtgctcaaaaagatttcaacgcacagaaacaagcctatttccaacgcatcgccgacatgaatttacgcaatccccgcatgataggtttcggaatttccaataaacaaaccttcgaaaccgcatccgctcatgccgcaggagccatcatcggcagtaaattcgtgaccttattggacgaggaaaacgggaatgcggaaaaagcggcagacaagctgctggaagctttgaaaaactgatcttccacaacccgtaaacgcagacgcagacgcagcagacgcaggcccttttttctcacacacgtgcgcgtacattatatatgtaaatgtgtatctatttttaataacctgttttaactgtcatcagagagggaggtcaaaacgaagatgaacgctctgaaaaagatacagattgtaactgaacaacataaaaaagttgtatccttattcaaatgtagagtgaatacgactcttttattgtcggttgaaagtacaagtttcagattcaaagttcattttctctaaaatagggtcttccaccttacggtagtttattctatttccccaccttgtattatacgcgcacgtgtgtgagaaaaaagggcctgcgtctgctgcgtctgcatctgcgtttacggcattcactcataatgccctcctcttcaaagctcacctgaaaggccagtacgatgaaggtgaaagatacagtaccttgcaggcataagattatatatcttacaagcataagatatataatcttacacgtaatctttccatatcttccacccaccctatccgggaaaaccagcctcggtccatagagaaaacattttgttatttttccctcttatttttgtcatacttatacataattactatctttgtgccaaaattaaacaagagaagcgcatgatacagagtgaatatccttccgttttgctaatatacacaggcggtacgatcggcatgattgaaaatcctgagacaggtgcactagaagcctttaatttcgaccagttacaagacaatgtccccgaattgaagcggttcaactatcgcatctcctcttaccaattcaatccccccattgactcttcggatatggaacctgccttgtgggccaagttagtcaagatcatcaaatacaattatgataattttgacgggttcgtcattctgcacggtacagacaccatggcatacaccgcttcagcgctcagcttcatgctggaaaacctgagcaagccggttatcctgactggcagccagctgcccatcggcatgttgcgcaccgatggaaaggaaaatctgatcacttccatagaaatagccgctgccaaacatccgaacggcactgctattgtacccgaagtatgcatcttcttcgaaaaccatctgttgcgcggaaaccgtaccacaaaaataaatgcggagaatttcaatgcgttccgttcatacaatttcccttcgctggcgacagcaggcatccacataaaatatgaatatgaccgtattcacaaagccgatcccaatctgccattaaaaccacactatctttatgataccaatgtaattatactgacccttttcccgggcatccaggaaaacatgatcagcaatatcctgcatacaccgggattacgcgcagtggtattaaaaacctacggttcgggcaacgctccgcaaaagccatggttcatcgaacttctaagggatgccacttcacggggaatcatcattgtcaacatctcccaatgctctaccggaacagtggaaatgggaagatatgaaaccggactccatctgctggacgcaggggtcatcagcggctacgacagtacggtggaatccgttctaaccaaactgatgttccttttgggacacggaaaaagtgaaagagaaatacgttaccaaatgagtattccagtagccggagagtttacgaaatcataatttattgcgttccaattattatccggcgggatgattacagaatcattaaaatggtgtaatctacgatgaaaacttaacgattttataacatgtaatctttttgtaatatttgtttcatcaaatagtaataaaaatgctccatctttgcaatgctgatcagaaaagattagttttgtagtattaaaaagatggatatatgaacgattaccgcattttagtagttgacgatgaagaagatctatgcgagattcttaaattcaatttagaaaacgaagggtattttgtggatacagcaaactccgccgaagaagccctgaagatggaactgacccaatacgacttactgttgctggatgtgatgatgggagaaatttcaggattcaaaatggcgaacatgctgaaaaagaataaagctaccgcttctattcccattatattcatcactgctaaagatactgaaaacgatactgtgacaggattcaacctgggagccgacgactatatctcgaagccattttcactgcgcgaagttatagcacgcgtcaaggctgtccttcgacgtaccagtcccacacagggaaaagaagtgcaggaacaattgcaatacaaagggcttttagtcgacatcaccaagaagaaagtcagcatagacggtatagaaatttccctgacaaaaaaagaattcgaaatcctgttgctgttgttacaaaacaaaggccgcgtattctcacgcgaagatattctggctaaagtatggcaagaggaagtctatgtgctggaccgtaccattgacgtcaacattactcgcctgcgtaagaaaataggcgaatacggaaaatgcatcgtcacccgcctaggatacggatactgttttgaatgcgaataacctaacctgtacctttccatgactattgaattatccagccacgtcctgtcattcaacaagaaactattcttgtcggtaatctccttattcatagcattcgccatctgtttcatggcattccaatatcgcagggagaaggaatacaaaatagagctgctgaacacacaactccagaattacaacgaccgcctgaatgattttctccgtggcagggatacgctgaatattcaacaattggacgactatgtatgcgaacacacctttgaagatctacgtgtgacactgatcaacaagaatggtactgtaatttatgacaatctggaaaaagatcccagccacttcgagaaccaccataaccgtcaggaaataaaagaagccatcacttatggcagcggctattccattaacagacaatcggaaagcctgggcggtgaatttttctattcggccaagtattatcctaacctggactatatcattcgttcggcccttccctataatgtcagtctgatgagacacttgaaagcagactcccattatgtatggtttacactgataatcagcctgatattaataattatattctaccggttcacacataaattgggaatgtctatcaccaaattgcaacaattcgccatgaaagccgaccgcaatgaaccgatagacactgatatgcaggatacctttcccaaaaacgaactgggcgagatatcccaacatatcatccaaatttacaaacgtctgcatcaggcaaaagaagatttatatatcgaacgcgagaaactgatcacccatctccaaatctcgcacgaaggtttaggcgtattcaaccaccgcaaagaagagattctggtaaataacctgttcacacaatatgccaaccttatctcagacaaaaatctgagttctacggaagaaatcttctccatccccgaattgcagcccatcacccgtttcattacaaaaaacaaggaacgcagtatcggcaaaggagagaaacggatgtcattaaacatagacaaaaacggacgtatctttgccgtggagtgcattatctttcaagatgacagctttgaaatctccatcaatgacatcactcaggaaaaggagcaagcacttctgaaaaaacagctgacacagaacattgcccacgaattgaaaacccctgtaagcagcatacagggatatctggaaaccatagtaaacaaccctaccctgccccgtgagaaaatcaatgcttttttggagagaagctatgcacaaagtaaccggctggcacatctgttacgggatatctccgtacttacccgcatggaagaagctccgaacatgatcgagacagaaccggtaaacctcaccaccatgatgcggaatatcctgaacgaagtaactttggaactggaagaaaagcagatcactgcccacaatatgctgcctgaaagactgaccgtacaaggcaattcttccctgctatattccatcttccggaatctgacggacaacgccattgcatacgcaggaagtcatatttccgtaaccatccgctgtttccgtgaagacgaacgtttttactatttcagtttctcggacacaggcgtaggagtagatcccgaacatctaagccgtttgttcgagcgtttctaccgggtggacaaaggacgttcacgcaaactgggcggcacaggcctgggactggccattgtgaaaaacgctgtcattctgcatggaggaaccattttcgccaagaacacccccggtggaggtctggaattcatatttacactgagtaaagaatgagaagatgacaagcacctgtttctaaattttcttcaaaatttaaacaggctctaaaaaataaagaaagataattgttttcttaaatataaactgtatctttgcggtgcatcggttcatttatctcccctccgaggtgaatgattaaaagggaatcaaggtgagaatcctgaacagtcccgctgctgtatgtttcactaaacgcataagcaaaatgccaataaccactgggataatttccgggaaggtgcttatagcggaaacgagtcagaagacctgcctgtgcatttatcaaatctgaagctttcgaggaaagagcttggaacactgaacgtaagggatgcctttaatcacatccgctattttctccgtttcactgtccggaaaagagtatcaggtaaaaagaacatttattttaaagtaaactctgccaagtttatttggaatgctcagccgaagtgattcgcctgagcattattttataatccaagtcaatacaaaatcgggatgagtgacataacggacccggtaacgtccctgccggcctgtacgatattcgcatgcctcgaactccccctcttccgacaggctgaaaggaaaaatacgaagatgacgaatgaaatccacctcctctactcccatcagtttgaacagtgcctccttggccgaccaatggagcaacaaagcgtaaacttcatctccttccatcattgtggactcttcatcggaacgaataaaacgggaagctactttccgcactctggttccatactgctctatatccattcccacctcacaggaagaatgaagcgccaccgctacataaccgcgagtatgcgagatgctgatataccggcttccatcctttagataaggccttcccgaagagtaataagctatctccttttcttctccacacaaagccttcagcagcacacgtaccgacaaccattcatgcttccgtctttcggaaaaaacagccagtttctccctataccaatctttatgctccaacgatgccagcagttgttccgttgtttcatcagacttccatattccaagcagaaattccccttcgctataagtacggtataaaggcatgataaaatctatttctttccttcttccatttccatggagtgggaagggtcaatgataacttttactttcaaaatgcggcgcgtattcatttcaagtacctcaaaatgataattcccgtaatccaaccgctcgtgcaatacaggaaactccccttttatttccagcaacaaaccggccaaagtgtccgcatctccttccactttctcgaaaagagcgggatcagctttcataattttataaaaatcggacagtaaggtttttgcctcgaatatataggtacggtcattcagtttcacatacgtacgctcttcatcatcgtattcatcattaatctctcccacaatctcctcgatgatatcctccattgtaacaatacccgaagtacctccaaactcatcgacaacgatggcaatatggatcttgtttgcctgaaaatcacgcaaaaggtcatcaatcatctttgtttcaggcacaaagtaagcgggacggaccaatgtttgccaacgaaagttgtcgcctttgcccaaatgaggaagcaaatcctttatgtaaagaatcccctttatattatcccgcgattcggcatataccggaatacgggaataggcattttccacaatgcatttcaacacttcggaataaggggtattgatttccaagtccaccatatccagccgggaagtcatcacttccttggccgtttcctcaccaaaacggataataccttctagaatattgctttcctctgaaatctcactcttgtccgtcaattccaaagcctgtgaaagctcgtcgacagaaatattataattcctttttgccacacatctgttcaccaaaaaggaagaacggaccagcaatgccgacaaaggtgaaaagaatttctttaaaaaagaaatggcaggagctgccttacggcaaaacttcaacgtgttctgtgccgaataaattttaggcatgatttcaccgaaaagcaatagcagaaaagtaaggacaaccgttattagcaggaattccagaatcacggaatttccaaagtgtatggtgctggcaaaaaaataattgcacagcatgataatggttacattgacaaaattattagagataagaatagtcgctaacaagcgttcggaatcattcagcagggcgctgatacgcctgtccgaagtatgttttccttcctctatctcacttaaatcaacaggtgaaagggaaaagaaagctatttccgaagcagacacaaagcctgaggcatacaacaataaaacagctaataagatagctataatggctcctatggtaggagccgttacggttacaccgtcaaataaatccgccaagcggcataaatacgagtcagggtccaaggaatctggttttagttaaacatcaagttctcttacttaaaaaggtaaatcgtctgtcaggctattatccgaagtttgctgttgttgcggagctacttgtgcagacatctgctgccgggataccgcttgtgcctgcacatatcccgtacccggttgctgtgaggcgttacgcggggtcaacatctccatattatcagcaaaaatctcgacaatggtgcgttttatgccattctgatcatcgtatgaacggctacggatttttccttctatgtagagtttgtcgcccttacggacatatttttccgcagtttgagccagccctctccataacacgatattatgccattccgtacgttcgggaacctgtgttccattctgcaacgtataggcacgatcggtggtagccaacgagaaagtggcaacggcaatgccggtatccaaatatctcacatcagggtcctttcctacatttccaatcaaaatgactttatttactgacattctattattcctttttaattattaggctccaaaattagcgaaaaaaactgattcaccaaacgcgatacggcaaatttatgcaaatcttccacgcttattctctgatacttcgcaaaagaagccgaattctcagggagaatcacttcataaaaatttgcgtaaatcacccggtgggacaacacgtgcttcacccctttccgcaccagccgcactatgggctcctctcccccggacagcatcccgcgaaactgtggcgatgcatacagttcctcttccgtccattcacgatctgtttctaccaaaggcggttcatacaaatttttccatatatcatttccgctgcgcttatgtataaaggtatacgcgcccatgcgtacatatatataattaaaataacgattggtcaccttgattttatgttgcttcacaggcaaagagctggcaatccccttcaggcgcgccacacaagaatcgcttagcggacaaaacaagcagtcgggcgccaccggagtacactgcaaagctccaaaatccatgatagcctggttatagagaccgggacactcacagtccagcaactcatcggcaatccggacaaacagtttctttccttccgtcgaatcaatgggagtatcaatgcccaaccagcgggacagtacccggtacacattaccatccaccacagcgtatggcatatcgtaagcaaatgaacaaatagccgccgccgtatattcccccactcctttcaaagcacgcaccccggcgtatgttacaggaaaccctcctgcctctgccatccttctggccgcagcatgcaaatttctcgcacgagaatagtaccccagcccctgccaatatttcatcacctcatcctcatcggctgcagccagtgcgaacacatcaggaaaacgagtcacgaaacgttgatagtaatcatatccctgagccacacgggtttgttgtagaataatctccgaaatccatatcaaataaggattttttgtctttctccacgacaaatcacgtccgttttccctgtaccaatctatcaattttctgctaaaattctccatatcagtattatataaaagtacattctatgcaatatttccgcaaaagtaaaccaagaaaatggaagaagatgctttttttaggaaatttattctgaatatatttcttaaagagggagaaaagctatatatttgcagtccaaaaaattaagatataagtataacaataattatttagcgaaatgactaaagcagatatcgtaaacgaaattacgaaaaataccggtattgacaaggtgacagtgttaaccacacttgaggctttcatggatacagtaaaggattcattgtctaaagaggaaaatgtgtacctgcgtggttttggaagttttgtagtaaagaaaagagctcagaagactgctcgcaatatttcaaagaacactacaatcattattccggagcacaatattccggcatttaaaccagctaagacatttacattatcagtaaagaaataataaacaagagtattaacccataaaatttgaagctatgccaagcggaaagaagaagaaaagacacaaaatgtctactcacaagcgtaaaaaaagactaagaaagaacagacataaaagcaaaaaataatttgtagtctgtctgtgacgacaaataaagaacaaaccttgcaaagcaacaaaagtctttcgggtttgttctttgtttaatgaggaaagtgaacaatttaagaatacaaaagtgacaagcgaactagtagtagacgtacaacccaaagagatttccatcgcactccttgaagataaagcgttggtggaatttcagaaagaagggagaagtgcttccttcaatgtgggaaatatgtatttgggacgggtaaagaaactgatgcccggccttaatgcctgtttcgtggatgtcggctttgaaaaagatgcttttcttcattatctagacctaggtcctcaatttcattcttatcagaagtatctgaagcaagttttaagcgaccgtaaaaaactttttcccatcacaaaagctactatgctgcctgatatcgaaaaggaagggacggtttcaaccaccctccagcaaggtcaggaagttattgtgcagattgtaaaggaacctatctcgaccaaggggcccagactaacctgcgaattgtcattcgccggacgttatttggtattaatccctttcaacgacaaggtttcggtatcacaaaaaattaaatcgagcgaagaacgcgcccgtctgaaacagttattgcaaagcatcaaaccgaaaaacttcggagtgattgtacgcaccgtagcggaaggcaaaagggtggccgagcttgatgcagagcttaaagtcttgctgaaacattgggaagaaacaatcactaaagtacagaaggctcccaaactgccggcattagtatacgaagagaccagccgcacggtagccatgttgcgcgatcttttcaatccgtcttatgagaacatctatgtgaacgatgaaacggtgttccatgagattaaggattatgtatcacttatcgcccctgaacgggccgaaatcgtaaaactgtacaaaggtcagcttcccatattcgacaacttcggtattaccaaacaaatcaaatcctctttcggaaaaaccatttcgtataagagtggagcttacctgattattgaacacacagaagcgcttcatgtagtggatgtcaatagcggaaaccgctccaaatctgccaacgggcaggaggctaacgcattggatgtaaacctgggtgccgccgacgaactggcacgccagttaagattgcgtgatatgggtggcattatcgtggttgacttcattgacatgaatctagcagagaaccggcagaaactgtacgaacgtatgtgccaaaacatgcagaaagacagagcaaaacataacattctgcccctcagtaaatttggattgatgcaaattacccgccaacgcgtgcgtcctgccatggatgtcaacaccaatgaaacctgccccacctgcttcgggaaaggtagcataaagccatccatccttttcacggatactttggagagtaagattgattacctagtcaacaaattgaagataaagagatttacgctgtacatccatccgtacatcgcagcatacgtgaaccagggactggtttccctgaagcgcaaatggcaaatgaagtacggattcggaataaagattatccccgaccaaagtctggccttcctgcaatatcggttcaccgatgttcacggtgaggagatagacatgaaagaggaaattgaaatcaagtaaaagaaaagggagtgatcgtgagtcactccctttctttatttcactactttggtattcaaggcttgatttcgaaattccacaaactcgaacaacttgtcacattctgccgattataacttgcccaaccatcaacaaaactggcaaaacaacagaccatctgctgcctctactttatttgccttgcttatagtctttcactattccctccgcaatccaatttgccaatgcctgacggttattcttcagaaccagccgctgttggtcacgcttgttccggatatttcccaattccagaaacaccgctacaggagtagtattacgcaatacatacaaattacgttcactcaccgtcccgcgaaaaccacggtttggctgatgcttgtcatatttcttatcaaaggtacggtgcaagttgttggccaaccgcttgccctttatactcttaggagcgttataaaaaaacacatccgtctgctgtccctggctgcgactgtccacatgaataaatacagctcgtttgtaattgctcttatccttccgatatagtttattcacccagtcacaacgttgcttcaaacgagccacctgattcaagggaatagggtctcccatgcaagtttcacgcttactgtttgccaggacatgaccgtcacgaataccatccttcttatcttgaatgataatatgtaccttcgcaccgcgtgacaacaactcacgtgccaaccgcagaataatatcgtatgcatactcatcctcatgcaactgacgcccctgatagataccgatggccccaggatcaggacctccgtgcccactcaccaaataaaaacaagctccgcttaattcattagatgtaatctgataggtggcatactcctttccaaataaagactccttgccggtacgaggctttttctttgccagaagcggtgatagaacaaaaaataaaaatgtaacaaatagtaccgataccctcattgcctgttatttttctcccaacatttcatctatcttcttgcacaaagaagaaaattcctcttcattgtacaaacgggtcagcatgacaatcttgcccgctttgtcaatcaacacattacgggtgatacccgccttacgatccgcatatctggcaaaaatatcagcccccggatcaagggccaacggataggtcacgccggtacgtttggcaaaagccactacagtttccaaaggttcgtcccgatccactccaaagagagcaaacgctttattatccttatgtttcaaccagatatctttttcaataaaaggcatctcctttcggcaaactccacaccaactggcggtgaactgaagcatcactaccttgccacgcaaatcagagagttttactttctgtccgtctgtcagctccatttcaaaatcgggagccatatcccctacctttactatataaccagcattatcaggagtaacctgttgtgccttcaccggctggctcagcaaacatgcgcaaaccagcaacatcagactcataaacttcttcatcgttattctctatttttatatattcgctacaaagataggctattccatcattttttcgtaattttgccacccaaaataactaccaacttatcaagaagatgaatattttttgggatacaatcactcattataatgcgggtacgtggatttatcaagttattattacccttaccggcattattttaacctgttctctattcaaaaaacctacaaaaaaaataaaggtagcaatgaagttataccttatattcttgaatgtatggatagctgccgtgtattacatgatttattgtgaaccaagaagttataacagtgctttggcaggattttgggggatcatggccatcttctggatttatgacctgaaagtaaactacaccccttttgatcggactcacaaacataccgcactagccgtcctgctttgtatgttgccactggcctatccactcttctccattataagggggatgagctttcccatgatgacctcacctgtaatgccttgttcggtagcggttttcaccatcggactgctgctggcattttccaaacgagtcaatatctttctcgtcatgtttctctgccactgggcgctgatcggtttcaccaaaacttactttttccatattcccgaagattttctgctggcaagttcggctgtaccaggactttatctgttctttaaagaatacacagcttcccatctgcatacttctacccttttccgtgcccgtatgattaatctcgccttaattattgcttgcggtgcaatcggtgtgctgttcatgatatctatggtgtgcgaactagctcaagaacaggctttatcgaaataaaaacacgtcttaatgaggtactttgcaaaatctttcgtacttttgccaacaaattgagttaatgttttaacaggatgaacgtattagaactaagtgaacaggagattatcagacgaaacagtctgaatgaattgcgagctatgggcatcgagccataccccgcagctgagtatgtaaccaatgcattttctacagatataaaagctgagttcaaagatgatgaggaacctcgcaaagtatcggtagccggacgtatgatgagccgccgtgtgatgggtaaagcttcattcatcgaattacaagactcaaaaggccgtatccaggtatatatcactcgtgacgacatctgtccggatgaaaataaagaattgtacaacacagtgttcaaacgtctgctggaccttggtgacttcgtcggtatagaaggattcgtattcagaacccagatgggtgaaatcagtatccacgctaaaaaactgaccgtactgtccaagtctatcaaaccacttcctattgtaaaatataaggatggggtcgcttacgataagtttgaagatcccgaactgcgttaccgccagcgttatgtggatttagccgtaaacgaggaggtaaaagacatcttcatcaaacgcagcaaggtattcagctctatgcgtgaatatttcaactcaaaaggttatatggaagtagaaactccgattctgcaatccattgccggcggagcagccgcacgtccgttcattactcatcacaacgcactggacatgccgctgtatatgcgcatcgccagcgaattgtacctgaaaagacttatcgtaggtggtttcgaaggtgtgtatgaaataggcaagaacttccgtaacgaaggaatggaccgcacacacaatccggaatttacctgcatggaaatatatgttgcctacaaggactataactggatgatggagtttacagaaaagatgattgaaaaaatctgtctggatgtaaatggaaccactcaggtaaaggtaggcgacaacattattgatttcaaagccccgtacaagcgtgtcactatgctggattccatcaaggaacacaccggctatgacctgacaggcatgaacgaagaacagatacgcgaagtttgtcagaaactgaacatggaaattgacgatacaatgggtaaaggcaagctgattgatgaaatcttcggagaattctgtgaaggtacttacatccagcctactttcatcaccgactatccgaaagaaatgtctccgctgacaaaaatacaccgcagcaatccggatttgacagagcgcttcgaactgatggtaaacggcaaggaactgtgtaacgcatactctgaactgaatgacccgattgatcagttggaacgcttcgaagaacaaatgagactgagcgaaaagggagatgacgaagcgatgattattgacaaggactttgtccgtgcgttagaatatggtatgccccccacttcggggatgggtatcggtatggaccgtctgacgatgctgatgaccgggcagtctaccattcaggaagtattgttcttcccccagatgcgtcccgaaaaggttactccgaaagacactcctgccaaatttatggaattgggaatttcagaagactgggttcctgtcattcagaaagcaggctataacctggtgagcgatatgaaagaagtgaatccgcagaagttgcatatggacatttgcggaatcaacaaaaaatataaattggaactgaccaatcctacggtggatgaagttgccggatggattgcgaaaattgagaattgagaattaaaaattgagaattattccaattgtcaattatccatcataaataataagcatgaaattgcccggtaaaatagcgataatgggtggtggcagctgggccacggctattgcaaaaatagtcctggctcaggctgactcaatcaactggtatatgcgccgcgacgacagaatcgaagaattcaagcgtttgggacataatccggcttatctgacaagtgtgcgctttgatataaagaacatcaacttttcatcagatattaataaggtggtaaaggaatcggatactctgatatttgttaccccctctccttatctgaaaagccacctgaaaaagctgaaaaccaaaataaaggacaagttcattgtcactgctatcaaaggtattgtccctgacgagaacctgattgtttccgattattttcaccaggtatacggtgttcccgaagagaatatagccgtcatcgccggtccgtgccatgcagaggaagtagccttggagcgtctttcttaccttactatcggatgtaaagacattgacaaggcgaaaatatttgcccgccaactggccggacattatataaaaacttctgtaagcccggatgtggcaggtatagaatatgcttctgtgttgaagaatatttatgccatcgccgccggaatttgcagcggtctgaaatatggcgacaacttccaggccgtattaatatcgaatgccattcaggaaatgaaccgcttcctgaataccgtacatcccgtagaacgttctattgacgattccgcctatctgggtgacctattggtaacgtcttattccaatttcagccggaaccgcgtattcgggaccatgattggtaaaggttattccgtaaaaagcgcacagatagaaatggaaatgattgccgaaggatactacggaacgaaatgtatcaaggagttaaacaagcacttgcacgtgaacatgcctatcgtagatgccgtatataatattttatatgagcgcatctcgcccatgattgagattaaattattaactgattcattcagataaaatatcagatacaatgaagaatattagtttaaacatcgacaaagtagccggttttgcttctaaggaaacaatcgctgcttacgaacctcaggtgaaagcctgcatggaaacattggaaaacggtacaggtaaaggtaatgacttcttgggttggttgcacttgccatcgtctataacagccgaacatttggctgacttgaaagctactgcccaggttctgcgcgacaactgtgaagtagtagtagtagcaggtatcggtggaagctatctgggagcacgggccgtaatcgaagctttatccaatagtttccaatggttgaaagcaaaacaagacggacccgtcatcgtatttgcaggccacaatatcggcgaagattatttgttcgaattaactgaatacctgaaaggtaaaaagttcggtgtaattaatatttccaaatctggtactactacggaaaccgctttggctttccgtttgctgaaaaaacagtgtgaagaccagcttggaaaggaaatggcgaagaaagtgattgttgccgttacagatgccaagaaaggtgctgcacgtgttacagcagataaagaaggatatcagactttcattatccccgataatgtaggtggccgtttctctgtcttgactccggtaggtttgttgcctatcgcagtggcaggtttcgacatcgaaaaattagtggaaggcgcacgcacaatggaaacagtatgtgggccggctactccgtttgccgaaaaccctgctgccgtttatgccgctacccgcaatgaattgtataaaaacggcaagaagattgagattttggtaaacttcaatcccaaactgcactatatgaacgaatggtggaaacaattgtacggtgaatccgaaggcaaggacggtaaaggtatttatccgtctgccgtcgacttctctaccgacctccattctatgggacagtggattcaggaaggtgaacgtactatcttcgaaacagttatctctatcgaaaagccggaacatacacttcaagttccttcggacagcgaaaatttggatggcttgaatttcctggcaggaaagcgtgtggacgaagtgaacaagatggcagaactgggaactcagctggcacacgttgacggtggtgtacccaatatgcgactgattgtgcccgagctgaatgaatattatctgggagaaatcatctatttctttgaaaaagcttgtggtatcagcggttatttgctgggagtaaatccgttcaaccaaccgggcgtggaagcatacaagaaaaatatgtttgctttgttgaacaaaccgggatacgaagaagagtctaaagccatccaagctagattataatcgtcaagaacctataaagaatgccatttatcaatgtcattctgaatgacagtgaagaatctgaaagcatccaccaagtgcttgcagattcttcactttgttccaatccaacggtcacaaccgttggaagtaataattatacatttattctatgtttaaagaagcgataaataactatcttcatgctcatggatacgaatccatcgacctgaaagccgtattattcgatatggacggagtgctgttcgactccatgcccaaccatgctgaagcatggcataaaataatgaaacgcttcggtttcggcctcagccgagaagaagcttatatgcacgaagggcgtaccggtgcatctacgatcaatatagtaagtcgccgggagcgtgggcatgatgctacagaagaagaaataaaagccatctaccaagccaaaactgaagaattcaacaaatgccccaaagcagaacgaatgcccggcgcactggaagtattgactaaaataaagagcgaaggactgactccgatggtagtgaccggttcgggacaaacttcgttattagaccggttaaatcataattttccgggcatcttccaagcagacttaatggttaccgcctttgatgtgaaatatgggaaaccaaatccggaaccgtatctgatagccctaaagaaaggcggcttcaaacccaatgaagcgttagtaatagaaaatgcaccactaggtgtacaggcgggagttgccgccggtatttttactatcgccgtgaatacaggaccattgcacgacaatgtattactgaatgaaggagcgaatttactttttcattccatgcccgacttcaataaaaattgggaaacactacaatctgcattaaaacaagattaaattttgcaagaattcttcacaatcaataaaaaagagctccttgctttcacctagatgaaaaacaaggagcccatattatataaaaaatcacagcctatcaaaatacctgaacctactttaaaactttgcgtaaccaaggaataaccagttcgtttttaaaataatgagaagggggatctacattgaccgtttcgaaataggtctttgaatccagtccttcatcaaggtgctccacatcttttctaactgccttatcagcaaacttcggataatgataaaactccgcattttccggttttccactagcagcataagcagattgcaccaaacggaaatcacggtccaaccctccctctgtaaaaatgataggacgaggagctaatgacgcaacaacatctggaaaattaaaatacctccaataaccaggtatcagatgacggatagaatttggaaaaggacgcctgttttccttgtcaggtttagtcatcacaacggcacgttcttgagtctggcatagaaaatcattgtacacaaaagcataaatgtccttatccaacacccccaagaccatcatcggttctgtacctaatgagaatccgctaatcacaatcctgtcctttcggatataagactggtctttcatccaattcagcacttgcatatccagataagaagtataccctagccaactccatcccagttcaagcaaaaaacgggaaacaacatcatagtcataattccatcctttatcataacattccaaatcggaggcttctccggcagcggcattatccaccgctaccgccacataaccttctttaaccatattcaaagccatacttactttgggattattataatcctcagttaacttatcacagatgccgggctcaccggccaatccttctttggtccttccggaacccggaatgcacaagactccaggtactgcacccttcaaatgttccggtttcaaaaccagaaaagtggaaactgactttggaaaaggatagaactcccatttctctaaaatatatccctcttttttttccgttttcacacagacaggagacggttgtccctttatctcgggaaacttcatgatctccaccattgcagcacgcactccatcctgccattgcgtaaaatcctgtgcggacataccggaacggtaagcatattggggatgtgtatctttcaacatctcatgcacaatggcataagtacttagtaaccgtccatccccacgatctgatttcacaactgcatgcttctcaggttggtaattctgagaattaccaaccatacataagctgcatacagatactaaaaagagcaatcttttcattatcatcatattatctcactattattcataccccggagtctgcttgatttccggatctccattcaaaacttccacattaacaggccacaacatcatatacgccttatcctctgttaatataggcaatgaacttccataatgcgctttaacagaaaagacaaaaggttttccgttggaatcacgtaaacgcaataaatcaaaccagcggcttccctcacctacaaactctttatcacgttcctgcaaaatagcccactcattatccgcataatctcctgcgatatatttatgttgttcaaatttatcaccataagcacgcttacgtacctcatttatatatgcagcacatttatccggagctcccaacccgttttcacactcggccagcatcaacaaaacatcagcatatctatataccggtacatctgaatcataataatgagttcctccatccgtatgtcccatcagttttttccaacaagcgccacgagtctttccttcgaacatatattgaaagaaagtagcatccaaacgagtatcttccttatcataaatctcgataaacggcactttatactcataacgtaatggtccggctgtcaatagcttcaacggatccggaccatatttatttccatccaagtccgtagcattggtaaacaaggctacattatagaaccagttcgccccccaattggtcaattcattcttattaaaacacagagcgaaaataatctctttattcttcttcccctccggagtccataaatccgcaaagtttggaagcagttcgaattgttggttcaccaaattcaataaagccttctttgctgtcaacaagtcactgttattaggatctacggcagtcagagtagctatatgatcccctgcaatatcatcatcgggtaatcctgtagtgactttggcagaccacatatatatcttggccttcaaaagttccgttgcataataagaccattcatattggtcggacatcttcttatccgactcattgaagaaagcttcggatttattaatatcttctttgataaactctaacgtttcctccggagtagaacgagccttatataattgcgtaatatcaatgctaccctcggtaactttcggttccgtctctaacggcacaccaccaaatgttcgataaagatagaaatagtaatatgcacgcaagccataagcctgtcccaaataaaatgatttctccattccagtcatataatcaatttctttatctacatttctgataaacaaatttatatgcatgatatttgggtacacctcataccaatcatcgacaccggtattatctttcgtaagcagattattagtcataggcggaccatataccccctcacccatagaagtaacatcacttatcagaatctcacttctgaactctcccaatgtgacaggcatctgatatttatctcttaaatcggcatgaataccagtcataaacatttctacctgagacttctgattccaaaaatcattagagccataataatcttcaggagacaggtccaacgcatcacaagcagacaataccatcatcccactcaacaatatgctataaaatattttcttcataatccttcctatttattagaatgtaacatttaaacccaaaacaactgttctagggaggggatatcctccattctgactgacaccatattcgggggtcgccatatttttggctgctgtaatatatcccaaattctgtgctgttacagaaacatccaccttgctcaaaccggatttatgaatccaactctgaggcaaggaatacgacaggcttatttcacgaaaagccaaataatcgccacgataacaattaatgtctgatattctgtcataattacgtttgcctaaaaagtcagcccatccatacaccggatattttccattcggattactttccgaccaggaatctttaaccaaagatatggtattaaatgttccctgcatattacccataatccaaggagttttccaatcatgcacccaatagcctaaagcataatccagacggcagttcaaagttaatcctttccatgaagtattaatgttaaagcctccggtccaatgaggtatcgtattacccaatttcacccggtcataatcatcaattacaccatccccattcacatcctgccatttcacatcaccagcctgtataggcagtcctttctccttttcggcatccgacaatttagcccaagcttcaggtccatagagcactttggcatctgctccattttccgtataagtggatctgtctatcagattacctggaatctcactctcactcttataaataccaagagatttaaaggcgtaaatcacaccatattcctgtccttcctgataaccacccacccattgtctttcataggtaccatctgccagcttgcgtcccgtataaacctgataggcatcctgcatattattcggcaatccattgtacggtaatgagataatcttattcttattataagcggtattcatactaactgtaaatttccaatctttggtacgcaaaacattggcagtcagttctaactccataccttggttttgtacttctccattgttagaaaggaaagaagaaactccgctatgggaaggcagggtgatttctgcaaatttatcctgtgtacgtctattataataggtgaagttcaagatatatttgttattcagaaaaccaatatcgaaacctgtctcgaatgtgtacgatttttcccatctcatggtgggattaggcaaatcgtttatcatcaaaggaactttgccattatagttgggtactattttaccatctttatctttcataataccataagagccttgaaccgtataataatcaagtcctgtcactacattaccattagcatccagtacaccagacacatttccattggcaccgtaactagcacgaattttagcataagaaagtacattgctacaagactccataaaattctctctactcaatacccaaccggctgatataccgggaaaggttccccaacggttatcttttggcagcttggagtatccatcgcgacgtaaaacaaggctcagcaaatacttggacttataatcataattcactctaccaaagaatgaaagaatgcgttgtctgtaatgccaggaatctatttgccgcactccggcagcagtcgaagtataattcaaatcctgaaaatcagataatggagatccataaccggacgccgaaaaacctttcttgtatgagtcataatattctacgcctgccatcgcatctatagaatgatcttgccggaatgtagtctgataattcaagattccattgtaagtctggtccaaaagtcgttcatgcttgttggaagtactatgattagtgtcatacaccggtcctgtagctacaatatagtcccctttgaagaactctctgctgtcatcaaaataaaaccaagttcctgtggtcttgaatgtcaaccctttcattatattaaaggtaaaagactgactcaaattaaacttgtctgtattattatcatagttcaatgcatcctcatacactttcactgtggtccagccacgggcataagaagccacggcagggcctgccaaccaatcgccatccggacttttcacacggaatgtaggaggaacggacaaggtagtactgaaaaaatcaccttcaccggcatatcctgcaccaccatcgtcccattttgcatcggtaaatgtcaaagaagaattagaagtaagccaaggcttaattttataatctgcattgatcgtgaaattcaaacggtgataccagttgttcatcgcatttccttcgctgcgattatagcctaggcttgcataataatgtcccttatcattgccgccggatacgctcaagttataatcctgagtaatagccggagatttgatattataatctttcagctgattatcacaataaatcaatttttgtcccggattcaccgggtcatccattgtctgccaaccttgttttaacaggaaagccagatcatctgtataattcataacaccccatacggctgtattgtccttattgccattaagtacattccctttttcatcaaaatatctgtttcctgttccgtaaggctgtgttccggataaagtcgcatcactggcaaatccatgccaagcgcccgatttatcctgccatatatgcgaagaccgataaaatgctgaacgcatataatacaaataatcatgagcattcaaaaactcatactggctatggaaaaaattgaaaccgactttcgcactcaaatttatttccgtatgtccttccgaacctcttttagtagtaacaagaattacaccattggaagcacgcgcaccgtaaatagctgtagcaccagcatctttcatgacctccaaagactcgatatcctccggattcacatcactcaacgactcgcgtacagcaccatcgataataaccaaaggtgaaccgctaccatccagattggtaccaccacgaagtaccaaagtaggagtggaattcggattaccactagtttgctgcacccttaatcctgccactgcaccagacagtgcttgcgccggattagtatggacacccgtacttaaagtagaattatcaactttagcaatagaattagtcatcttggaacgaagttgtgtgcccccataacctgttatcaccacttcatccaaagtcttattgtcttcctgcagttgaacattcaaaaacggctttttccctacaaccatttcttgagtcagataaccgatataagaaaagaccaaagacgctttttcacttaccattaacgtaaactggccgtctatatcagttatggtaccattggtagtacctttctctataatattagccccaataattgcttctcctttggcatcggtcactatacctttgacagtcactttctcttgttgcataacaatgggaggcgtttcttctctagaaatggccttacgaattattacttgtctgtcacggatatgatattccaaatcagtaccggcaaacatttgtttcagtacctcctctattgttttattccgtacatccacattgacacgacgagacaaatcaatatctgtacgatatataaaaataaattgactattcttttctacccaattaatcacactcttcaaagtctggttctccatagaaacggtaaagctagtttgttccgcataactcatttccgcaaaagcctcttcataacttgtaaatgttaaaatcatggctaaactcatacattttgtgaatttaggcatgagttttattctattcgtgtattttttcatatatttgattgttttttctatttatttcaaggtaaataattaaacaacgattcagtgaccagatagtacggcaaatactgtctggttttcttttttttacattcttcttttattccataggctaaagtgttttaaggttcaacaattctcatttaaggctcacatagatttcatctttatcatttattgtataatgcaatgataatgaaagacataaattatccataacatcggtaatgtctgtttgaagatccagttttcctgacaatgacaaggtagtaatctccgcatcataccgtattttacacccataataccgctcaagtttcttcaaaacatctcctacgggtctttgatgaagcagcaataaattatccttccaactgatgtattcggacacatcaaccttacgtacctgcgttttattacctttaatatccaccaattgattaggtgctaatcttactttgctcttattctcagtagttacttccacgcttccatgtactaaaacaacagatgaagcctcatcttccctataggcacagacattaaacgaagtacccagtacgcgtatatcaaactctcttgttttgacaacaaatgggcaatccttccttttggctacatccagataaacctccccctctaccaggatttcacgtttctgttcttcaaaaatatccggatatatcactttactacctgaatttatataaattctagtaccatcagaaaaagtaatatcagctcttttcccattaggaaccattatctggtgcatttcattctttacagatgaagcctgggatattttagtatttaatgcatactgctgaatattcgaacttcctaaagtatcatattttaaagaagcatcatttttcagattcatagcttggttatctgttatcagaatcacctcatcaccgcaaatggaagtcgtgtcattcagcaatgctatatcaagctccgtaccctcatcagcattggtactccaccagttcatagctaaaatcaaaccaatcgctgccgctatcgacaaagaccacctataaatatgacgtctgtaggaaaccctcttttccctttctactcgtttcatcacgtcctgaaaagatttttccacatcaacaaattccaattcatctgcttcccgaatcttctcagtcaggcatcgaactgttttacgaaattcatctgaattatatattgtttttttatttttcatcgaaatacctttttattaagaaaacggcacccgataaaaaaggtactcataaaaaagaaaagaaatcacacttttctttgcatgagtcttcgtaagaccaatagataaaccttatatgacaaataaaaaaacttattcatcacacaaatatcacttcatgaaaacatgcccaaatgataaaacaacaacaattaactactcgctaaatcaagagaagtgaaaagcccaaacactacgcacaggcacatgaacacaatgcaccaagatactgaaaatccaaatggttgaaacagagaaaaagaattcacgcaaacgtgccaatgtacgcgacaaaagattcttgcttgattgaggattcatacctaagatagcggatatttcctgatggctcaattcctttacataatataaatacagaatttcacgctgacgaccagaaagacgtgaaattgccttagccagcctcctttcattcttcacatccacatcatctttcttaaataaagaatttattatttcttcacccatcggaaaaaactcatggcattcttcaatcacttccattggacgtaaagactgaaacgcatccagcaatttatttctaaaagaacaaagcaaatacgcctttacattatcagtataatgcaaattcctacaatttaaaatcaacttgacgaacagattctgtatggtatcggcaaccagctctctgtcacctaccatacgaattccataggaatacaataacgaataatagcgtcgataaacttcttcaaatgccgccgtttctcctttaatgaaagattcccaaagtttagtttcatcatgtgttctatcaaccataatactagctccttaaaaacttattgagcttgctcagagttaaacttaacaagaaggcaatataagagatgaatcatgtaatggactcatcccttactttataatacctacatattattcaaacagtttactgcgcgacaacatacaggcaccgataatcccggctctttctttcaatttagattctacaataacagaatcacggttcatcaagttcagtgtatattttcgaatagctgtagtgatgggttgtgtcaaataatcacctgtacgtgacaatgcaccaccaataatgactagctccggattgaatatattaataagtcccgctacatggcggcctaatttcactccaatttcttccaccagttcaatacacagcaaatcttccttatttaccgcatcaatgatatcatccaaggtcaaatcttccaaatttttcttggtattggagataatagagttctcaccattattaatatgttccaacagaatacgatgcaaagcagcccccgaaacttccgtttctatgcatccttttttcccacaatggcagataatctcattctcatatccaaaattatgcccgaattcgccagagaaaccggattttcctttataaatctttccatcaatgataattcccatacccaatccccaactgacattgataaagatgatattcttctcacctttcacaacaccttgcatatactcaccgtaaatcatagcacgggtgtcgttgtcaatagaaacacgataaccacccaccttttctgatatgacatccgtcaacgggcgctcatcaaaattgaatatactgtaactatatcccaaatccggattcacacgcccggaaagatttacattaatatttaatatcttatctttctcaacactgactttttgaagaaaatgtttaatcaacttacacaattcgtctaaactctcaggggtattcttcgctttaaaaggaacattcatttttagctgaactacatctcctttaaaatttatcaaccctaagttaatggaaaactgacgcacttcaacacctacaaaatacccggaatctgcattcaaaccatacaaactgggatgtcttcccccactggtttccagctttccatagtcgttaatgtaaccttcctcacacatttcatcgatgaattttgtaactgtaggcacacttaaatccatctctcttgctaaatcagtaatcgtagagcttccattataaatataatgggtaatgattttcttcttcatcacagccatctttgagcccttttcaatttctttcaacaaattctcacccataataaaatattccgttaatgtccacaaatatagttatttttttatgaaatcaaatcacatttaaagagaattttcaaaaaatattttagaagatgtaagcaaattatcattttttgtaacaatcccactttccagatacatttaaataatatttcctagtcgtttattcatctttctatttattaaaagagtgattattaataaataaatttagtttttacttgttgttttcataaatcatttatatatttgcacgcaacatgattaagtaatataaaatattcatttcaaataaattaaaggctatggaaaagattcacggattaattgatgcaccttttactccattttatgagaacggagaagtaaattatgaacctattgaagcctattgccaactattggttagaaacggacttcaaggcgtatttatcaatggttcttccggagaaggctatatgctgacagaagacgaacgcatgaaactggctgaacgctggatggaagtagcacccgaaggattcaaagtcattgtccatgtaggaagcacttgtgtaaaatcaagcaaacgtctggcagaacacgctcagaaaatcggagcatggggtatcggagcaatggcacctcctttccccaaagtaggacgcattgaagaattggtgaaatactgcgaagaaatagcatgcggcgctcctgcacttcctttctatttttatcacatcccagctttcaacggagcattcctctcaatggtagcattcttggaagccgtagacggtcgcattcctaatttcgccggtatcaaatatactttcgaaagcctgtatgaatacaaccaatgccgtttatataaaaatggcaaatttgacatgttgcacggccaggatgaaacgatccttccttgtctggctatgggcggtgcacagggcggtatcggtggaacaaccaactataacggcaaagaactcacaggtattatcgaagcatggaaagccggtgatctggaactggcacgcgaacgccagaatttcgcacaggaagttatcaatgtcatctgtcactatcgtggaaacatcgttggcggtaaacgcatcatgaaactgatcgggctggatttaggaaagaaccggactccgttccagaacatgacagatgaggaagaagctgccatgaaagccgaactggaagcaatcaatttcttcgaaagatgtaacaaataaacctgaaccacgatgttttcaatagactatataaaagaatggtcggaatcatacaaaacagatctgaccaccaatatcatgccgttttggctgaaatacgggctggacaaggtcaatggaggtatttatacctgcgttgaccgagacggcagcttgatggacaccaccaaatcagtgtggttccaaggaagatttgcttttatctgttcctatgcatataataatatagaaaagaacgaagcatggctggcggcagccaaaagtacaatagactttatagaagcgcattgttttgactctgacggacgtatgtatttcgaagtgactgccgaaggcactcctttgcgcaaacgccgttatattttttcggagtcattcgcagccatcgccatgtcggaatatgccatcgcatccggtgaccagacgtatgctgtaaaagcattagacttgttcaaacggatgcagtattttatggaaacaccaggcatactggctcccaaatatctggataccctcccgatgaaaggacattccattaccatgattctgattaatgtggcatcacgtatccgtcaggctattcaggacgaaagcttcaatggacagattgacgcctccatcgaccagctacgtaaagacttcatgcatcctgaattcaaggctttgcttgaaacagtaggtcccaacggagaattcattgacagcaacatgggccgcaccatcaatccgggacattgtattgagacagcctggtttctgctggaagaagccaaataccgtaactgggacaaagacattacggaactggccctcactatctttgattggtcctgggagtggggatgggacaaagaattcggaggtatcatcaacttcaaagactgcaagaaccttccgccacaggattattcccaagacatgaaattctggtggcctcagacagaggctgtcatcgctactttgtatgcatatttagcaaccggaaatgaaaaataccttgacatgcacaaacaaatcagcgattggacatacgcccattttcctgataaagagtgtggagaatggtttggatatctccatcgtgacggcacgcctgcacaaatggccaagggtaacctattcaaaggcccgttccacattccaagaatgatgatcaagggctatacattgtgcaaggaaatactcgacaacaaaaaatcacatttataaagccctttatctattagcatgaaaaacagtaaaatttatccttgggttgtagtaggattattatggggtgtcgccctgttgaattacatggaccggcaaatgctatccacaatgagagatgccatggcggtggatatcaccgagcttcaatcagctgccaattttgggcgactgatgggagtttttctttggatatatggctgtatgagccctatagccggaatggtgggcgaccgcatgaaccgcaaatggcttattgttggcagtttgtttgtatggtcggccgtcacttatctgatgggaatagccgacacttataatgaagtctttttccttcgcgccttgatgggaatcagcgaagcgctctatattcctgccggattatcgctgatcgccgactatcactccgataagtcacgttcattagctatcggtattcacatgaccgggctctacaccgggcaggccatcggaggtttcggcgctacagtagccgccgctttttcctggcatacaacctttcattggttcggcatcgccggcattgcatacgccgtaattttgatgctttttctacatgaaaagaaggatagaatacaaattgaacaaataaattcaccttccggtaaagaaaaaagcaatttattgaagggattatcattacttttcagtaatattgcattctgggtgattctgctatatttcgcagcccccagtttaccgggatgggcaaccaaaaactggttacctaccttgttcgccgagaacctgaatataccgatgtcacaagccggccccatgtcgactatcaccatcgcactatcctcgttcattggtgtaattattggtggaaccttatccgataagtgggtgcaaagaaatataaaaggacgtgtgtacacgggtgccatcggcttgggacttactattccatccctgcttttactagggttcggccatagtttcgtagccgttgtgggagctggattattattcggtatcggttatggtatctttgatgccaacaatatgccgattctatgccagttcgtatcatccaaacaccgtgctaccgcctatggtatcatgaatatgacaggcgtgtttgcgggagcagccattaccgaagtcttgggaaagtggacagacggaggtaagttgggactgggatttgccatgttggccatcattgttgcaatagcattggtcgtacagttgacattcctccgtcctaaaacggataatatggaataacccgtatagttaacttaacacttaaaacttaaaaaaagaaagaaccatgagagtaattatcgaacctgattaccaagcgctgtcacaatgggcggcaaactatgtagctagtaaaatcaatgcggcaaatccgactcctgaaaaaccttttgttttaggttgtcctacaggatcttcaccgctgggcatgtacaaggcactgatagaactgaacaagcagggaaaagtatctttccagaatgtcgttactttcaatatggacgaatatgtaggcttacctgaagatcatcctgaaagctaccatacatttatgtggaaaaacttttttaaccacattgatataaagaaagaaaatgtacatatactaaacggaaatgccgaagacctggaagcagaatgcgccaactacgaaaagcaaatagccgaaatcggaggcatcgacctgtttatgggaggtatcggtcccgacggacatatcgcattcaacgaaccgggttcatctttgtcttcacgcacacgtatcaaaacattgactacagatacaatcattgccaactcacgtttttttgacaatgacgtgaacaaagtacctaaaactgcgttaacagtaggtgtagggactgtcctttcagctaaagaagttctgattatctgcaacggacacaacaaagcacgcgctttgcaacatgccgttgaaggtggtatcacacaaatgtggactatcagcgcattacagatgcaccaacatggcatcattgtttgtgacgaagccgctacagacgaactgaaagtcggtacttacaaatatttcaaagacatcgaaaaagctaatttgtaatttatgagaacaaacctaagttcgcagatttctctgaacagagtatctccgaaatattataaacccgaaaatgcggtggaacgttctgtcttaacccgctgcgaaaaagtgcctaccgacatctatgaaacgatggaagaaggcgtacaacaaatagccaatgaaattacggcaaaaattcaggaacgtcagcgcgaaggaaagttctgcgtgattggtgccggaaccggtgcttcattacgtccgctttatgccgaactggtccgtaaacataaagatgaaggactaagtttccgtaacgtagtaattttcaatttatatgaatattaccccttggcttccgaaggggcgggaagcagtttctcacaactgaacgatttattcctcagccaaatcgatattgacaaacaaaatgtattcaccatcgacggaacgattccgcaggaagctgttatcgaatactgccgcctgtacgaacaacgtatccaaacttttggcggtatagatatcgtattaatgggcattggtcgtgaaggcaatattgccatgaacgaaccgggatcaagcttgagctctcctacccgactgattttgattgactcaacctcgcgtgctgaagctgcacacaacttaggagtagacaatcttcctccctgctccatcaccatgggagtggcaactattatgactgcccggaaaatctatttgctggcatggggagatgacaaagccgatatcatcaagaaagcggtggaagacaaagtaagtgacaccttacccgcttcttatctccaaatgcacaacaatgcaaatgtttgcatagatttggctgcagcttctcaccttacccgtatccaacgtccgtggctggttaccaactgtgaatggaacgacaaactaatccgcagtgccatcgtatggttatgtatgcgtgttaaaaagccgattctgaagctcaccaataaagattataatgaaaacggattgagcgaactgttggcactttacggttctgcttacaacgtaaatatcaaaatattcaatgatctgcagcacaccatcaccggatggcccggcggcaagccgaatgcggacgacacctatcgccccgaacgtgcgaaaccatttccaaaacgtgtggttgctttctctccgcatccggatgacgatgtaatctcaatgggtggaactttacgccgtctggttcagcaaggtcatgaggtacacgtagcatacgaaacttccggaaacattgccgtaggcgatgaagaagtagtacgtttcatgcacttcatcaacggtttcaaccagctttttgatgaaaactccaacgaaaccatcaaaaacaaatatgctgaaatcaagaaattccttgccgctaagaaagaaggcgatatggacagccgtgatattctgaccatcaaaggattgattcgccgtggagaagcccgtaccgcaagcacttacaatcaaattccactgaaccgtgttcatttcctcgatctgcctttctatgaaaccggcaagattgaaaagaatcccatcagtgaagccgatgtagaaattgttttgcagttattacgtgaagtaaagccccatcagatttatgtagccggtgacttggccgacccgcacggaacccatcgtgtctgcacagacgcagtgcttgccgctattgacatcgagaaagaagccggtgccgaatggttgaaagattgccgcatctggatgtatcgtggcgcatgggcggaatgggaaattgaaaacattgaaatggccgtaccgttcagtcctgaagaactgcgtgctaaacgtaactccatcttaaagcatcagtctcagatggaaagcgcaccgttcctgggcaatgacgaacgtctgttctggcaaagaagtgaagaccgcaatcggggtacagccgctttgtatgaccaacttggtttggcatgttatgaagcaatggaggcctttgtggaatacgtacccctataatttaagaaacaacctaacctaattttatactaacctttaaccaaaaaaccgaaaatccccgatggatgtgatatccctcggggattatttttaggtttccacttatctcaaacgatatccgataatcatcctcaccacagctgcctgtttcgagaaacacacacccaactacatttcataattcattaatcccatagccaaacaaagcaaaatcccccagacaagggtcttcgggaaaaacctcagccaaagccgcagtaatagttctcgcattattcagcgtataagatttacttcgggtcagctccaatctgaaagccatctcactgacatgcgtatccaaagggataatcaactcacatggagagaaattcctccagattccaaaatccacttccgaatcgcgacggatcatccagcgcaggaacatattcaatttcttttgcggcgccttatccgacactccaaacaaacggcaaagacgttgcatcggagttccatccgtttcgcaaagaagagcatcctccatactctcatacctattatatatagtatgcagccaataaaacaattgtgccatcttattttttgaaaccgtccgatagaacgactcctcaccacagaaatctattttccagtttccagacaacacatactgcaaaggctgccggtgcattatagaatccagtcgttctgctgccttcagtatctgagggcgggctccgaaactaagaaaagcagtcaaaaaagcactgatttcaatatccgccttagaatgataacgatgcggaaactgcaccggatcagaggaaatgaaatcagagttatgataccggacagcatatttccgcaaaaaatcagccactgccatctggccctcatgagtttgccgttctgtaatataagatatgaattgctcttgttctttctttcgggtcataaataaaacgtttatgatttgtacacaaaggtacattaaaataaaatagattgcattttcagaaatcaaattccatccttaatcctcaacttgccttttctatattctttaggtgaaatccccacatattgcttaaaatactttccaaagaaagactgcgtagggaaattcagctggttcgcaatctccttgatactcaaatccgatccttcaagcaattgtttcgcctcggtaatcaccatttgcacaatccattgcaaagcgctattccccgacttctccttaatgatcgtagaaaaataacgtggagtaatgtgctgcatcttcgcataataggcaacatcacgctctttcctatacaaacggaaaagagccagcatgaaattctggaagatcacatccttcttattctgtggcaaaggctgcatgggttggttagcgaaatacatattcaatatttcatagcaaaaagtctgtcccattgacttaatcaactctaaagtcaggcgttgttgttgcaaattcacttccagtacgtcctccgcccctatcctttcctgcaaattatccaacagatactccaaatggatacgttgcttatccgaaagtgatatacaaggatgcttccgcataaaaagctggttttccacatttatcaccctattgacgataggaatgatataatctaaatccacttcaaccataattccttccgcatcctcgctcttatgaagcagatgcaccaaggtagaagccatgtaaatatacacatcaccgggctttatctgaaaaagcttatcttccagtgaaacctccacatttcccctccggcaaaagaaaaagccacatttattaaatgtagaaataatctgtccgtctttaaaagtatgcggatcactgctcgaaagcactgtaaactgaaaaggcatctgttgtccgaccatccatctatctcttttattcattcactgcaaaataaatacaaatcgcaaacttttcagctatatatctactagaaaatatacaaatcggacaatttatcattcatatcaaccttttctatcctcttgcttcgggataactttgcatcagaaaaccaatagcatgatatatgaaacaaatttatcttattctaacaggtatttccttgattctactgagttcctgcacacagcgtacccaggaagccaaaggctatcagacagtaaaaatagacacgatcgtttctgccgacaagcaaactttcctgcaattcccgggaaaggtaaaagccgcacaagatatcagccttgccttccgggtaagcggaaccatcagcaaaatacatgtaaaagacggtacccgtgtgcaggagggacaattactggccgaactggaccccaccgactatcaagtacaactggatgccacagaagcagaataccagcaaataaaagcggaagcggaaagagtcatggccctttacaaagacaacggaaccacccccaacgccaatgacaaagctgtatacggactcaaacaaatcactgccaagtacaaacatcacaaagaccaactggcttatacacggctctacgcccccttcaacgggtacgtccaaaaacgcctgtttgaagctcacgaaaccatcggagccggaatgcccgtcctatccatgatcagcagtgggactcccgaagtagaaataaaccttcctgcggccgaatacatccgccgggaccagttcgacaattatcactgtacgtttgacatctatccgggcgaaacctatccgctgaaactaatcagtgtcaccccgaaagccaatgcaaaccaattatacaccatgcgcctgcaagtagtacccggaacgccggctgtcccctctcccggaatgaacaccatggtcaccatctcttaccgcacagaacagacgaacactctctctgtccctaccggcgccatcctgcaaaaagaaggcaaagcgtatgtattcgtcttcaacccatcggacaacacagtgcacaaacaggaaatatccatgctacgtttactgaacaacggacacagcctcatcactgccggacagctgaaaccgggagagctgattgtatcctcgggagtacatcacatcgaggatggagaaactgtaaaacctttaccacttgtcactaacacaaatataggaggattattataatggatatcagcaaatgggcattccgtaacaggaatctgatttatttcctgatagcggttctgctgctcggcggagcctactcctgctatcagatgagcaagctggaagaccccgaaataaaagtaaagcttgccatggtagtcaccacctatccgggtgcttccgcccaccaggtagaactggaagtaacggacgtgctcgaaaagaacatccgcaccatgggtaacatagacaatatagaaagttattcatacaacgacttatccctgatacagatagaactgctgagcaccgtgccggacgacgaagtggaacaatgctgggacatgctgcgccgcaaagtaagcgacgcccacgccctgttgcccgaaggagccaccaccccgatagtcaaggatgatttcggaaacgtatatggtatgttctatgccctgacaggcgacggactgtccgaccgtgaactgtccgactatgccgaactggtgaaacgggaagtgaacgaactggaaggcgtggaccgtgtggaactctacggcaaacgttccgaatgtatcaacatctccctgctgcaagaccgtatggcaaacctcggtgttaaacctgccgaagttctcgccacactgaacggacagaacaaaaccacctatacaggatattatgaaaatggtgacaaccgtatccgagtcacagtaaacgataaattcaaaaccgtagaagatattggaaaaatgctgatccagggacatgatgacgaccagcttcgcctgagcgacatcgcccgtatagaaaaagactacgaggatcccacacgcaatgaaatgttttatgaccatgaacgtgctctcggtatactcatcgccgcctccagtggctcggacattataaaagtaggccatgccgtagaaagcaagttggaagaactcaaaaccggacgcctgcccgccggagtggaatgccacaaaatcttctatcagcccgaacgggtaggcagctctttgggaacctttgtcatcaacctgatagaatccgtcatcatcgtagtactgatactgatgatagcaatgggattcaagagcggccttatcataggtatcagcctgatcatcaccgtattcggttctttcctgttcctttattcggcaggtggaacgatgcaacgcgtatcattggctgcttttgtactggcaatgggcatgttggtagacaatgctatcgtcatcatagacggcatactggtagacttgaaagccggaaaaaaacgaatggaagccatgaccgctatcgggcgacagacagctatgcctcttttaggagccaccttgatagccattatcgcctttctacctatctacatgtcccccgacaccgcaggagtctacacgcgcgaccttttcatcgtacttgccgtttccctgctgttgagctgggtattggcactgattcacgtaccgctgatggccgaccgcagactacatcctgccatagataccgacagtaccggaaagcgtgtgtacaaaggtaaaatctatgccggtctccgttcggcactgcggttcggtctgacccaccggtggagttttgtattcaccatgattggcctgttgctactttccgctttcggctatccatacatgcgtcagggctttttccccgacatggtttacgaccagctttacatggaatacaaactgccggaaggaaacaaccacactcgtgtggcacaagatttgaaagaaatagaaacctatctgaaaggacgcaaggaaataacccacgtcaccacctccataggcggtacgcccggacgctataacctagtgcggagcgttgccaacccatcgctttcgtatggcgaactgattatcgatttcacctcaccggaaaccttggtagaacatatagatgaaatccaagcttacctctcccaagcctatccggacgcatacatcaaattgaaaagatacaatctgatgttcaagaaatatcccatagaagcacaattcctgggccccgaccctgccgttctgcaccaactggccgacagcgcccgtaccatcatggaaaatacaccagaagtctgccttatcaccaccgactgggaacctcagattcctgtactgaccatcgaatatgaccagccgtccgcccgtgccctcggcctgagccgcaatgatgtcagcctttccctgctcactgctaccggaggaattcccatcggctctttctacgaaggcatccacaaaaacaatatctatctgaaatgccttgacgaaaaaggagaacccatagaagatttaggcaatgcacaagtcttctcgtcactgccctcgttgaacggactgctgaacgaagaaaccatggtgaaactgaaagccggcacgctttcgaaagaagatttggtggaaagcatcatgggaagtactccgctgaagcaaatcagcaaaggaattgatatccgatgggaagacccggtagttccccgttacaacggtcagagaagccagcgtgtacagtgttcgcccgcaccgggcatagaaacggaaaaagcacgtcttgccattgcagaacgcatagagaagatacaactacccgaaggatattcactggtgtggcaaggtgagaagatagccagcgaccagtccatgaaatacctgttccagaacttcccgttggccatcattctgatgattgccatcctgataatgctattcaaggactaccgcaagcctatcatcatcttctgctgtatcccgatgatttttgtaggagtggtagcagtgatgctgctcacggggaaggtattcaacttcgtggccatcgtaggaaccttgggccttatcggcatgttgataaagaacggaattgtactgatggatgaaatcacccttcaaatcagtaaagggatagaacctgttaccgcattgatagacagttcccaaagccgtcttcgtcctgttatgatggcttcgctgaccaccattctgggtatgattcccttgctgtccgatgccatgttcggctcactggcggcagctatcatgggcggattgctgtgcagcacgctgattacgctgctctttatacctatattatacgccttgttcttcaaaataagaaacgattgatttatttcactgacatacaaaaccaagaacaaatgaaaaaaacaatgataatccccttctgttttctgttatggcatcttgtcgccccggcacaggcacaggaaacactgagtttgaaagaatgccgtgaaatggcattgaaatacaataaggagatggcggcttctgtaaaacaaacagaaagcgcccactacacagccaagagttacaaggggaacttcttccccaatctgacagctagtggaacgggactttacagcaatgccgacggcagttatggcatagccggaggcaacctgcccgtctttctgcccgacgccaccggacagtttaatccgggacaaccctcaggtttcgcctattttcccggtatcaacctggattacaagataggatgggtctacatgggtggcatacaattagaacaacccctctatatgggcggtaaaatccgcgccgcctacaaaatgtccctgttaggtaaagaaatggcacagatgaacgaaaccctgaccgccacagaagtcattctgaaaacagaccaggcatacgctctggtagtgaaagcgaaagagatgaaaacagtggccgacacataccatgccgtattggccgaattgcaaaagaacgtggagagtgcctacaagcacggactgaaacctcagaacgatgtgctgaaagtgcaagtgaaactgaatgaaagtgaactgggcatacgcaaagccgagaatgctctccgcctggctaccatgaacctctgccacctgataggaaaaccgctgaccacggagatcctcatttccggagatttcccggaaatagaacaggaaatggaattacaggtactggatatcacccgtcgtccggaatacggtatactggacaaacaagtggccatcgcccgccaacaagtcaagttaaaccgcagcgaactgcttcccaaagtaggcatcaaaggttcatacgactatgtacacggtttggaactgaacgaaaagaattttctggataatgccagtttctctgtcctgttgaacgtaagtattccccttttccatttcggcgaacgcagcaacaaggtacgtgcagccaaagccaaactggaacaaacccgtctgcaacagcaaaatctgaacgagcaaatgctactggaactgacccagaccgccaacaatctggacgaagcgaaactggaaagcgaacttgccgaccgttccctgcggcaggcggaagagaaccgacgcgtcagcaaaagccagtacgaagtagggctggaaactctgtcagaccatctggaagcccaagcactatggcaacaggcatacgaaacccaagtggatgcccgtttccaactttacctgaactatgtggcttatctgaaagcagccgggactttacatgacaaactgtaaaagtctctaccctgagtttttggttcttcttcattttgggtcaagtgatttattcatatccctttattcatcggctattagattgtattcggggatatattattctctattttcgaatattcattcgaatgtctttattggtcgaactttggtagtgaagtgttgcccccaaaatgaagaagaaccccgagttttaaaaagtgctaccactgctaccaccctttcttgtataaccacctttcttctctttttattcccaaacggataaaaaaactaaacttcgggaacactttcctgcttgcgcagcacatacaccgcatgagagtgctttccctctttgtccaatctcttctcttcgtaccaacccttcagctcataagcagccgtggtgcgcgccatccccaagcattccgaataaaccagacgtgtaatggaaccgtgttccttcaaataagcttccagcaatttccaacgctcctctttagtatacttcttccccgtaggcaggaagccgaactcggcacgaaggatatccgtatcctgacgtaccctcttgactaactccggtaccggacggaagttcactttctttatcctcacggatgccgcacgtatctctttccggtctgtcacctcacgcgaggacaaggcaagagagaacgtacccagtccgtccagccgcacatttttcccttgccgcaaatgggatacaaccatatcagccacctcctgtagcactcccaccacacagcccgccgaatatgcgctgtgcttggacaactccttcacaatgtgatcggtagtaatcgtttccttcaccactaccgccggataaagcaccggcttgccgtccttttccttgaaagggttggccttgaaatcatattttatatccatcattaaaagatttgatctgtatccgtaagccctttctgctctatggttaagggttctcttccttttgtattctatctccataagctttggacttaactccaaaggctatggagttatctccaaagcttatggagtcaactccgcaacctatggagatagaacacatctggacaaaagtacttaatctttaggggaaaaaggcttaatataacggaaaagatggattaaggagaaaaataatcaggtagttggccccttcgtaaaaaatagaatgaataaacaaaaggatacgaagtgatttgatgtacacggaaagcaatgaaaacattgtctgatataaacagaaccgttataaccaatcatctgaaaatatatttgatatatatgagttagaaaaagaagtcctatgcgcaaaatcgacacttgcaacaaaactctcactgcctttttgccacatatcacttttttatcgtatttttgtgttggcaacaaactaatacccataatacacagactgatgaaaaccaccattttacttggcttattattaactcttacagcttcatgcaaacaccattccacccccgtaactacagaagaaaacttccacacccaagaagccaaccgtctggtagcagaagcgggaaacctatggtctccttctttggacagcactttcttctttaataatgacagtgaacatatctctataaacgacaaggaaatatgggccaaactggacagcgcgttagccattgaccctaccaatataaaagtgtatgtgggaagaatcagttatttatcagcgtgcaaaaagtaccatgagattctgtctgtactccggcaagccgaaaaacaatccaccctcagtgccgacttatggtcaatgaaagcgatgtttgaagattatttcggagacagccttaccgcccaaaaaaattatcggtctgccgattccgcctatgccatcctcataaaagaatatgctacagacagcctcaagtatgccagtttccgcattaaccgcgcactgaacatggcattgatgactgataatattgcggttcttaaagaagaggtggaactcgctaaaaagatatttcctgagacatggaaaggacttgacacgaatgtttacgggaaaaacaaaaaagactttttcgacaaatgctttaacgtccgcaaaaagtaatcctgcctgctacattaagaaaattactaaatcattgcatttgaaagaacagacctgtaatacctactttcaatacaaagatttttatagcacaaaggtgtaactttctcccctttctgccgactaacctttggaatcttgctttatgttttggctctaaactttatcggaattataaaactggaaaaaaataaagaaagaaatctggaagaacaaataaggaatgtactccaatacaaaaagttatttcattggggctatattacaggatacccaattgttaccatattcctcggtgtatttttttataattaccatcaatggtggatggtattgaccatatctatcttgatgctgatggctattctgactgactatttcctctttcattatgtatctgacagaattaaagagctgacacgggtgaacaaagagttggcagaactgaaagaggagcataaagaataatttttcactccattatgagggtacttaaccggatattttattcctttgtaccctcaactagaataaaaaagcactttatgtttcagctgtatctgctgcttcgtttaaaaaattttggaaggatagtcatagaactgggcatcttcagaatagtcttccttaccatcttaacggtggctgccatcatgatattgttcttggcagaaaaccgtttcgtcattcctgtggtatgcgttctcttattggccagctatcataattatagaaaagataaagagtttctacacactttaacgtcccatcttccagtcttcctgatcaaagagtatactttaatcacattgccatttgcgggaatggaaatgataaaagggcgatttacagaagctatcggtttatggctgttcgccacgttattgcctttcctgaaagaaattaagctggaacacaaacctatccgcttaccttttctctacaaaggaagttatgaatatatacggatgttccgccaatctttctggatatatgccctactcttgcttttttccatagcaggaaccgtacacggaaatataaaaatagacaaagtgtgtgtcgttctatggggattgatacaggcgtcaggctatctgcaaccaatggacaccggatatcttcttcatttcaaaaatttcaagactttatgccgtttccaatcgaaaagtatcgcatggaatgttttcatcacctccattcctttcggcttagcacttatagcatctacctatgaccaagatgaaatcctctttttcttatcttattatatcgccaccttgatttatgccattggcatcagtatgttgcgccatatcatcccatcccccctattgctgtttattgtgcaattaagtatattgatgcctttttatttaggttctctttttgttccgtttcttttaatacccggcatggctcttaccacattgttgacctgccagacacgcaaacatttaaaaagattactatgatagaagtgaatgatttacataaaaaattcggtaaagtcaaagtattaaacggtattcatttagaatatcaccctggaaaaatatatggtttggtgggtgagaatggtgccggaaagactactttattcaactgcatgacgggaatctataattataccggaagcataaccaaaagcaaaactttaaaagcaggttatctgtctgcatccaacttcttttattcccaaatcacgggtcttgaatacttggaattctgtatgaaggccaaaggtctgccggtcagtacactcaccattcaacatttaaatgaaattttccaactgccccttgacaggtatgctgccgaatattctaccggaatgaaaaagaaactgggatttatggcattattattgcaagaaaatgacgtatttattcttgacgagccgttcaatggggtggacttgaaggggtgtatcctgatgaaaagactcatccggcaactgaaagcaaaagaaaagacggtgataatttcatcacatctcattgcctcgttaagggaaatatgtgatattatccactatctgaatgaaggggttatctacaaagaataccatgaagaaacaacagaagagatagaagaggatatattatgcaacactaaaaagatacagtccacctcatactttcagtaaaacacacagcactgtccttacatgaaagctacaagtttaactccatcccaattctttttcaccactgatattgcacagataccataaattcgcgaggacgaagttttacccaagaagtataactctgcacagcagaataaagagtataacgatattgttccttattaaacagatgcatagcagaagcggtaaacctccattttccggatttatgtatcaatgaaacatctgcaagccaagtattcagatgctggtccttgcttaaatcattataaaaatgctctccggataaccggaagtccgtatcatgaaatcccaaactgagagtcagccgttgagctacatcccacaaagggtctaaacgggtatcctttcctattccggaacccccacaactgaccgtcgctttgtattcaacctcaaaaagtgcagaaggggcccacacaattttaggttcgacgcgcagatagtcatacctgtaattctgaacgatattttcattcaactgtttaccttcattgcgtgctaaagtcagttccagagaagtcttcaaattccagtcatatacccctttcgaccctatggtattcaaggcgtaactataagaggaatgatttctttccacagacgaaagataaaaattaccgtccttataattacgttctgccatcagattataacgattgtgggaataggaagctgataaagtccagaaaaattccttgacagtatttttgtattccagatagcaggtataaagttgccggacggttacagctacttttcccgtgtgtttcaccacagtacgataatcttcacgataatggaaaggatagatatcctgtattcctccttcactctcgtccaggctgcctgataaggacattttccaacggggactaaacttatagcgaaaataaagggagggagcggcataaaaacgggaataagattgctttggaagacgattccaccagacagtggcagcagcggtgagtaaaaaatcagtcctctcccattctatacggggaatagtatagaaggaataacgaggagcagagtaactattctcctgtctcaccgaagaaagttcgccacgaaaaccacctgtaagctggtaattcactccattctttttccgcatcccataaagggcgttatccgtgtaggcattgtcgatgttcatttcttcatattccgtagggatagactcatatgtctgtccggtgacagttcgatatgtgttttcgttgatgttatcaggcaaattcaattcgtccctacggtggatgcaggtggcaatcagtctgttatcggcagatgacacgggcaggttgcggtgaatcactgtcagtaaagcaggaagatgggtgtaacggatatacgaccggattccccaggtgtatttttctttggtgtaaagttggttgaaataattcttcaattcccattgtgaattctttatcttttggaaaataacattatcacccgttatatccgaaactcctgatttccatgttcctgcaaacgaaaaattctcacgagtgtaccgacttgcagcattatcttcataatttacttcaccattcagacaatcggtttttaaacggtcatgccggttggtagccgtatgcaccgtatcttgtgcaaaataatagatttcctcacttccatattgccgggttgtgcggtcatggatataccctaactgaaatcgtaattgcttttcttcatccaatcggtacaggcggttggcagaagctgtatgcgtttcattgaataacagccttttttgcgacaagggcatggccggttcgggtaaaggaagaaaaatgggaggattgctgtccgtcacccggtcaaagccattgccggatgccagtttctgttggtcggaaaacagattccggcctatattatttgccttgtaagtatagacagtctgccggttacgactcaattgcagtacattgaacgaagcgtcgtaaagtgccttctctccataacctccccctgccataacggtataaatccattgggaacggacttcgggtttcaatttcaaattcaaggcaacgtcatccgtaaaggtcttgccacgcaaggacttaatgggttggtgtccttcaatgacctccgctgcctgtacggcatccgctttcagattattattaatttgattataacgaccgccactcacatccataccttccacatagagattactgatcacttttccattatattttatagttccattctcttccacattgatgccgggaagttttttcaacacatcacttacattccgatctttggaagatgtaaaacgggtgaggtcatatttcaaggtatcctgccttccccatacgcgccccggacgaatctgtacttctttcagcaagacagcttcctgctccagttcgatagttaacggacgactgataagtaccggtatggtctttttcctgtaacccatataaaataccgttattgtcctgtctttcaaggatgaagaggaaagttgaaaacgtccgtcagcatctgtcaaagtatagttgatgatattgccatcccctccctgttgcaaagtgacggtagcggattccaaaggctgacgggtaactttgtccgttacccgtccctttatcgtgttttgtgcgtttgtgtgaatatgaagcaaaaagctcaacaaagagagaatgattgctgttttcatcttgttatttttcagataattctatcggattataaggtaactcaaagtttttcaacgtgttaccttgctcatcttttaccgtcaattttacattgggggctgtagaagtgataaagcctaccgggtccttggcataacgctcatataccttattcaaatctctacgactgatggattcaaaaccttttccattgaaaagaagtggtttcggtccacggaattgctcgatacctgtacattcaaatgaataatgtcggcggtcatcctcagcctttatgatgagacctggcaatccacaaagtttccaaggcccttcacttacaggaatttccatcgtgaaccatgccgtataacttcttccccggaagtgaccagttgctttccggcaatgataagtcagaatagtagccgtatcgggtaataaggtccataccggtttttcattcttttcctcgcaacggaaattactggtagccaaccggtcaagcgttgtcacctttcccgtaggatagttcttataaatccgatatgtaatacgcccgtttccataagccttggcatgttgctgcaagacatcttgggacactttattagcatagtcggcgatcaaagtagaatcccgaagataagtagtgtaactataaaattgcgaacatttctttcccacttccagcatcatcgtttccgaattgggctgacggtcagccttagttgtgtcctctaccatcttcaactcatactgggcacggaaaaccaattcatctatgggttcgcttttcttcacatcatccatagcgagaatggttatctgcgccgtagccggcaatgccatgattgcccaaaataacaggtttgccagtttctttttcataatccgaattgtttttaagtgatgaattttatactgcaaagctagatccttctctccttcccgataccacaaaattattactgaaatattacgccgatgaaaatacaaccctcgtgtacattgcatatctaaggatagcccgtacctttgctttaacgaaaaaaagaaaagatggaaaaaagaataaaaacagtatggatactgactatcattacagctatactgataataggcggtcaaggctattggcttcaccaccaatattgctattcaacgagaacgttcatgcaggaactgcataaacaaatactgcaactggaaaaagaagaaatgaatacacgctatgacaaacggactaacaaccacaaatatacactgagctacaaaatagaaatgccggattcggtgaaccaaaacggcaaaacaacctgtgtcattagtttttatagacaaaaaagtgaaattaataatctggattcattgataaaacagaatgcattgttgaatgaggaaagtgttatagtccgcgacagttttcgggtagagaacatttccaatgaaattctatttgatgcagccacacgttatggagccgagatgacccacccctttcgatctgaaatttttgattcactattacaagccaaccagataaaactgacaaatatcagactgatgcagactgattctatcctgtggcatggaagctatacctcttccacccgattgttcaaacctgaaatgtatattgtttatccttataaccctttacttaaacaagcattgacggcatccatacagatacctttcccctcccttctccaacaaatggcatggcagctgttgggtagcctgatattagttctgctcttggtattctgccttatctaccagatcaagaccattttgaaacaacggaaaatagacgaaatgagaaaaagctttgtaaataccatgatacatgaactgaaacgccccgtacaaaccttgaaaatgtgtattgcctttctcaacaacaagtccatgcgtacagacaaaagagcaatggatgaagtagtaaaggattccatgtttgaactggacaatctttctgcctacctagccaaagtaagggatatgacacgggctgactatgaacacacgcctctccacatccgtacttttgatttacgggaaaccgtaaataaattaattcggcttaccaatatacctgccgataaacaggttacggttcatccgtactataaaatggaatccactttggtcatcgccgacccggtacatattgccaacatcatcagcaacctgatagagaacgccatcaagtactccggtaaagaagtccggattgatttatcctgtatacagaaaggacacacccttactatacaaataacagataacggaattggaattccgccagcagagcaaagcaaggtttttgataagttttatcgcggcagccatataccagaccgaaatataccgggtatcggactagggctaagttacgtaaaacttctcaccgaagcacaccacggatacgtatccttgaccagccagccgggtaaaggaacgactttcagtattgtattacctcaataatcatttcaacaattcatataagatgaaaacaatcaaaatacttttcgcagatgatgatttaaaatactccatgctcttaaaacgttttttggaagcagaaggctatgaagttacttacgcagggaacggaaacattgctttacagcaatttcccttaataaagcccgatttggtattgcttgatatcaatatgcccgaactgaacggctttgaggtagcggcaaaaatacggaaacaaaatcatcaggtacttattttctttctttcagaccgtagcgataaagccgaccgtctgaaaggttttgatctgcaggccaatgattatctagcaaagcctttttatcccgaagagctgttggcacgtatccgtgaacggtttcaatgtgtagacaacagaattgaaacagaaagctatacattcgggaaaagtacattcaactataccactaatgaaataaggacaggaaataacaaggtactgattacttcccgacaggctgagatactccgaatattagctaaaaacctccatgttcccgtagatcgggaaatactgttgaaacatgtatggggagcttcatcctatgccaattcgctggcattgaatgtacaaataacctatttacgaaaagcgttgcgcaatgactccagtgtgaagatagaatcactgatgaagaaaggatatgtgttacacatagaaaaaggataagaaaactctttatagtttgcctttctgaatgaaatgaagaatgacgaactataaagagttcaaattgccgaaagcactcttttttataatgtataagttccttcgaccagcttgcccatcgcccatacggcacggatattcaaatcctggtcaagaatcaagatatcggcatcttttcctttctgcaaggaacctttacggtcatatactcccataaatttcgaaggagtttcggaagccatacggacagcatcctccaaaggaatttccgccttctgcaccaaggtacggatcaaacggtccatggtagccacactgcctgccaatgctgaacggtctgccagtttgcacacaccatcctctatgatgacacgaggatcgaaagccacgttactgtcactgaccgcacatgccaaagcatctgtaatgacacaagcacgttctacaccctttatcttataaaccaaccgtaaaatggtaggtggtacatgaatgccatcggccaccacttccacattcatatcgtctatcagataaatactctctactgttccttcatatttatactcacgacgcttgtgaaaaccgggcattgcattatagaaatgcgtggccagcgtataacctgaatcccatgcagaacgaatgtcttcatattcagcctgagtatgggccacagatgccacaatcccttttcccgtaatgtattttccgaactgcatagcccccggcaattcgggagctgcatcccaacgcttgatacaattccatttctctacaataggaatatactcattagggtccggatctttaatattctcaggcatttgtccaccggccatcttgatgttcagataatgaccttccaggtgcaatcccaataccggactgtccggttccgccatcaacttggtacaagtttcggcagccgcctcaatcatcggtacggtagaagaagacaatgttggaaaaatactggtagtaccatgtttcatgtgagcattaatggctgtacggaaagcctcttccgtaccttccataaaatcaccgccaccaccaccatgacaatggatttccacaccaccgggaacaacatacatacctttagcgtcaatcagctcggctccgataacagctaaatcacaattggtaacttctaaaatcttattgtcgcgcataaggacagacccgtccttcaaccagccctgtggggtaagaatctttgcgttaatgatttgggtcaacatgatactatgataagttaggatttttaattggcatattaaattcgccaacaaaaatagcaactttttcactttctgaaacagatttccccaattattttctaacttttttaataaataagccccgcttaataaaatcaagcggggcacagatagtggaaattgaaacaaatctttttacttacttattaaaactagcctacctgatttaagtcctttacctgttgcggtcagtgtaatttctcccggtttatcggtgctttgcacaacagcagtcatcattccgttaaacactttcatttgcggaacatggaaaagttccaatgaagtggggtctccgtttgcaccggcacgataggttcccgcaccttttacagcatacttgatgagatgctgtgcgtcgggacaaaggttaccttctttatccaccactctcactgtgacaaatgacaaatccttgccatcagcctttatttcattgcgatctgcaaccaattctatatggtcgggcttacctgccgtatggatttccttttcggctacagcatcccctttctcattgtatgcaaccactttcacggttcccggctcatactttgtatccatccacatcaaacggtagcgtttctgacgcttgaaatctgctatggaagcagaatccgcactattttcagccgttacagtcaaatccttggtacgcttaccctggctcttgccattgataaacacttctgcagacggataattggtatagacaaagatcggggtcacttctccttcacgtcccggccatgtccaatgaggaaggatgtgcagtgtctcttcatctttgttccaatggctgcggtacaaatagtaacggtctttgggcaatccggccaagtcgattataccgaacaaagaagaatggctgggccagtcagtataataaggagtcggttcgcccagataatcgaagcccgtccatacgaactctccgatcccccatgcgttatcctcgtgccaaatccagtcgtcttccggcaaattggaccaaccacaatgttccacatcgtaagaagaagactgatgatcgtcatatttcttcatagcctgacggacaacggggaatttatagacaccacgcgaacttactgtagaagctgtttcactacctaaaataatctgctgaggcaacttcttatagttttcaggatatttatggggacgataattgaaaccggccacatccataacggcagccatattattgtttaccacggcatcgggcgcatccataccttgtgttacagggcgggtggggtcttcacgatggcaaatatcctgcaacatacgcgagattttcggaccgttactgccgctccactgatcaggtacttcattacctgtacaccacatcacaatacttgggttattacgatagtgacgaatcagattcgtcaaatccttatccacccattcatcaaatactttatgatatccattggccatctttgccgatttccattcgtcaaaggattccgccatcaccatcatacccatctcgtcacaagcctccaccagttcgggagccggcatattatgagaagtacggattgcattacagcccatatctttcagaatacgaatctgacgacggatagcggcatcatttacagcacctcccaacgggcctaagtcatgatggttacatactcctttgaatttggtcaattttccattcagaaagaaacccttgtcggggataatctccaaggtacggataccaaaacgagtggtatattcgtctttcaaggtattcccttcatatactttggattcagccatataaagaaccggagtttcaggactccataactcaggattggctactgcaaactcctgttcaaacaaagtattgtcaaaaacacttaacttgttttccccggtagcaaccactttgccgtttttatccttaatctgcgtcacaatacggtaattatccttattggctccttcgggactaaccaaagaagttttcaaagacacttttgcatatttgtctgtcaccacgggagtggtagcatacgtcccccatgtcgggatatgcgcatcttcattgattaccagatgaacattgcggtacaaaccggcccccggataccaacgtgatgattcaggctcgttttccaaacggactgccagctcgttcttctcacccggtttcagataaggggtcgcatccacataaaaggaattataaccgtatggccaatagcctgcctcctgcccgttcacatagacacgggcatggctcattgctccgtcaaatatcaaagtagccttcttgcctttttcaaaaccgggagcatcaaagttcaggcgataccatccggttcctacaaatggaagacctccggtacggccggcatgttccaaagcctctgtctgtccatcctgagtgatagccatttcctgcttgtcgttattgatactgaacggaccataaatcgcccaatcatgaggaacggtgacgttctgccatttactgtcattataaccgggattggcaaattccgcattatcttcacgcgtaaatttccaccctttttcgaaagtctgctctgtacgtacctgcgcttgcataaaagcaaaacaacaaacagctcctaacgcagcacacaaaaatcgtttcgtattcatagttatttcttattaggattttctgttactataaaagtaatttcacctgccttgatcaaatcatcatgcgaaatcaaatatttattaagtttcttattgcccagtctgatttcctttatataatccccttgtccttctttcttgataaccaattctttcttgccccaatagttaggatcaagctgaacggtcactttatcaaaagtaggagtagtcaatgtatattcgggcacacccggacaatccggatagaatcccatcatactgaatatagcccatgcagacatcgtacccgtatcatcattgccaggaattccatccggcttagttgtgaaatacttagccagcaattccttcaccaatttctgtgtacgccattcttcacccttgaaacgactgaacaggtaaggataagctatatcgggttcattagccggatcataatttccttcatcgaacacgctttgcagcttatcgacaaatttcttatcacctcccatcagtttcaccaatccattgatatcatgaggaacaaagaaagtgtaattccatgcgttaccttcgtggaaaccgggactaggtgcaaaattcgctccttctttcgggtcaaacggttcatagaacttaccttccttggtgataggacgcaaagttccgaaatccttgctataataattcttataccccatagaacgtttgcggaacagtttcgcatcttcctttttacctagagcctctgccaaagtggacagcgcatagtcggcaacataatattccaaagcatgagaaaccgagttgtcatactggctttccatcggcacataccctttggacatataatcgtcattatccggacgcatcagattatccttgcccggagtagtggccgacttatacattcccttataagcttcgtcaatgtcaaagtcttgcaatcccttcatccaactgtctaccagaacaggaatagaggggtcaccttccatagtcaatgtttcacgaccatataattcccatttcgggaaccatccgtgttccttatacatacccatcatagtatgtatcatatccatctgacgttccggatagaccaaagtcatcaactgatggtagttacgataagtatcccacaatgagaacaccgtataacggttacggttggtggtcagaatcttgtctccctccatttgtggatattgtccgcttacatcctgcaaaatattaggatgaatcatggtatgatacatagcggtatagaatactcccttttgttcttccgtgccaccttctaccttgatacgggaaagatcatcgttccatctcttacgggcctccgcacgcagtttgtcgaatgttgtgccgaaaggctgttctttttccaaattcagacgagcattctcaatgctgacaaaagatacgcccatactgacctcaatcacttcttccgccgtagtatcgtaagtaaaccacactcctatatcatctccgcttatttcttttgtataagcagtatagagtttgtatttaccggctgtatcgtcccattgcgcctccacacccatcggacgcatcattttccaataaccgcgttttgccggtactttgttgatacgcattacaaaatagatgggaaatactgcctgaggattgtaacagaaagttcccaacaacttggtaccttcaatctcacggtcgtttacaaaacgaacggtagcaccactctcattggtcaatccctctcccagattcaacaagatattgctttgtccggcaggaaaagtaaagcgtgccatactggtacgtggggtggcagtcagttcacatttcacattgtatttatccagtatattggtataataacccggatttgcagtctcaccttgatagaaacttccataattatgataatccacatccagtttgccggtggtaggcatcaataacaatgaccccaattccggacagcctaccccgctaaggttaacgtgcgcaaaaccggtaagatatttattattgaattcgtatggagtggaccaccattgcttatctttatccttatccccttcgggaactcccatcacattgaaaggagtcaccgacatcattccatgaggagttaatgctccgggatttgtcgtaccgtaattagtagtacccacaaaagggtttacataatctaccggctctttctgtgctgccgcagaaaaaactgagatacaaatcagaacagccgataacaaaatttgtttcttcatgctatttgttgtttatataggttctattatttcactacaatttcatctgtaaacaagaaacctccgaattcacccgaagatgcctgataacgtatgtaacgtgctttggcatttccttcccaaccaaagttggtgaaagtcaccttgtcatccttcactactttgtgttccatgcgcttcagttccgtaaactccttaccatcattagaaacggaaatgattacttctgaaggcataaagacttcaggtccacacacctgcataaagtctgctccaacagaatgaatttctgtttctttttccatatcaatggtcacatccattctttttttgtctatgaaaccttgccagcgcttgtcaccataagtccagcctccaatcaccccatctaccaaggcactatcaccaccggccgaatagccgggataataagcggcatccggtccgtaagtcactttcttacctactgccaagtgttgtatgggctgatccgctcccggacgatttcctatctcatttttcaaatcgaaaggatggtatccttcagctttcaatgcctctacctctttcaatgcgcgagcatgaaaatcatcatagttcttcacagaaggatcactccaagcaacttccgccaacgcaagaatacgaggataaatcatcatttccgcatgttccggagtcggaatatattctgtgaataaattagcttgtactccatacactaactggactttatccgcactcaaagtatcgggtacaggattaaatgaataaactttggccaaaggcagataccctcctattgcttccggctgggaatcaggagcatcctgataagaatcaaaatagcagaactcacccggactcataatagccatgtggccggaatcaaccgctttcattcccccttccgtgccacgccatgacatgacagtagcattaggcgccaaaccaccttccaatatttcatcccaacccaataatttacgtccgtgggcattcaaaaagacctcgatacgatgaatcagataactctgtaactcgttcacatctttcaagccctcttttttcatacgtgcctgacacagtttgcaagtgggccatgaggctttaccggcctcatcccctcctatatgaatatattcggacgggaaaagttccatcacctctgtcagcacattttccagaaactcaaaagtcttttcattaccgacacagaaatcggcttgtttgtaaggttcgtgtgtacaagacaactcgggataagcagtcagtacttcttccgaatgtgcaggcatctctatctcaggaataacagtaataaaacgttcctgagcgtatgccaccagttcacggatatcatcttgagtataataacctccgtgagcatctttactaccttcttcttcataccgtcgtccgttattccaccattctttccatgtaggaaactcacgccatgccgcaaattctgtcagacggggatatttttttatttcaatacgccagcccgcagcgtcagtaagatgcagatgcaaacggttcaatttataatatgccaaagcatccatctgcttttttataaattccttgttgaaaaaatgacgggaaacatccatcataaagccacgataagcaaaacggggctcgtctgtaatgactcctaccggcaattctttttcatcagccatttgcagcatagtctgaactccatagaatagtcctgctccggaagtcgcacgaataagtacctgatcaggagttaccgtcagaacatacccctcggaagagtttacctccggcaattgagccacttgcttcaagacaatagtatgtccctcttctgccgctaccggtttcagcttcatgaaagaagccgccaaataatccttcaaaatctttttatctccttcggacgcatctatatacaatcctgtttccggattcagaggaaacacttcctgttgcaattccaccttcaatggtgcaggaataacagaaagtgtgcgttgctcttcctttgtgcaacttgcaaacaacaagcccaatgcagctcctgccaatataatcaattttctcatcttctattttctttaattctattaatttcattggtacgaatgcccggtttcagttctccattaataatgtaatggaatccgtcctgagaaactattacagctccggcacgcgcaccttgctcatattcgcctaatgtagtccatttattcgtctgtggatgatagagcagcagatttctgttaaaccgataccactctacaggatgtgacaaatattcttttcccgcataaataccttggagagcctttaagaatatatccttatcaactcctccggcacacaatatcatcccctcgccaaaagaggttcccattccaccacctaaagagatctcattaccttctgcatcacacggagtggcaaccgatgaccattctttcgtttccggagaatacatatatccatctaccgataaagaagcctggtgcccttcaatagccggggcaaagccaccccatatataaagttttccgtcttgcgccacgcaaacaggttgtactctgggttcacccggaatatctgtttcttttttccatcctccagacaaatccaacagatcaagcatgtacatggccgaggacggaatgccatttacatttcccccgacaatatatagtgaatgtcctactaatgcacctgccatattatctatagttgcaggtaaggatggtaacgtatcctttttcaaaacgtctttttgcaaagataaaagaaaaacatcagacaggctatgggttgctgtagctcctccaacacaaattaaccctttttcagtagaaatagtgactccataagctgctgcctgaggcagttggcctatttttttccactcaaaagccgtatcatttgacaaagaggttatatatacatctgggtaaaagacttttttcccgccatcggccgccggtgtatcgggaaaattacaacctccggctattaataaatttccatcaatcactcccgcatataatgcagaaactcccttaagaaaaccagcatcctccgtaggaaatccctgcattttctcaagagatatttcataaacatccggccggctgctacaagcagtcactaccatcatgcctattatcgcataaatgccatatattattttcctgatcatgttttcatggtgaagtttacaaattctttacaagcagtgttgcgcagctatcttttaggacaaacgctacgcaacaccagcactgattttacaattaatctacagtaatttcatctacaaacagaaaagcaggatttcctttacctccatgccaagaaggaatattgtattccggctttgccaatactttcagataacgtgctttcacaggttcaaagctcaatacatgttcatataattggtttggattatccaaagtcattgcaggatattcttctgaagctacttgcttgaaattctcaccgtcttctgaaacagcgacactgatggaacgcgcgtcaaatatccagtcacccttctccacatttgtagtaagtgtcactttgctgaaatcagccggctgcccgaaatcaatcacggcttccatatcattcttataaaaagcaatccaacgtcctgtcttataatttctatttcctttcaaaccatccaccaaggtagagataccggcaaattcatattgcttgttcacaggttgtagagctgttattttctttgaagtcgatttgctgaacgcaatgtcttctttcacaatacgactattgcctgtaggacggacagccatagccttaaacgtgcaatttgtattgatcttcaccggttctgtataaagctgtgaagcggtagtgggatctgtgccatccaatgtataatataccggacagttgtctacagtagacaaagtaacatccaccgtaccagtttccgcattaggctcaaaccgggcagtcacatcaaacacgtgcttggcataattatactgatatacatcatatatcttcaccatacgtaccaaacgctgcaagaaatcctgataatccttatgttcaggatttgtccattgaatatctgccaaagcggccatacgtggtaattccatatattccacctgactaaatgtaggaatatactcagtccacaaattagcctgtacacctttaatatatttctgttcctccggtgtcagtgatgccggcataggttcataactatacacacgttctaaaggtaagtaaccgccaatggcttccggttcctgttccacatccttgctctgataatagtcaaaatacaaataagtattcggtgacataataacatcatgcttctgcttggcagcctcaataccgccaccttcaccacgccatgacatgacagtagcattaggagccaacccgccttccagaatttcatcccagccaataatctgacgtccgtggtcattcaagaatttttccgcatgattgataatgaagctctgtaatttttcctctgccgtgtggttcttgtcagccttaatacctaaagctttgatacgatcctggcactttggacattttgtccaacgcactttaggacattcatcaccacccacatgaatatattctgacgggaaaatctgaataatttctcccaatacatcatctatgaatttcaaggtttcatcatttcctgcacaaagcacatcttccgataccccccagattttccagacttcgtacggaccacctgtacagcctaagttaggatatgcagtcaatgccgcttgcatgtgccccggcaaatctatttcaggaataaccgtgatatgacgttcggcagcataagctacaatttcttttgcttcttcctgtgtgaagaagccaccataaggctttccatcatattttcccgagttatgaccgataacggtttccgttctcttagaacccacctccgtcaattcaggaagacctttgatttcaattctccaaccttgatcatctgtaagatgccaatgaaaacgattcatattatgtaaagccaacatatctataaaacgctttaccgaatcaaccgggaagaaatgacgggaaacatccaaatgagcaccacggtaagagaaacgaggatagtcattgatttcaaccgccggtaaagcgatatccactccttgtgccaccggaatagatttacgcaaagtctggatgccataaaatactccggcttccgtaggtccggaaataaccacttggtcgctggttaccttcaactggtatccttcaggatttttagcatttccacccaattgcaggattatccccttgccatctgtgccagcttgtacagccaatgactttccggtaagatctttgatataacttgccagaaattcagcgttcttttgcatcttttcattgccttccggatacattatcttagttccatttgacaaaatgaacggagcagcctgatccattaccgaaatttcctgcggtaacggaattatctgataatttgcttcttttacttctgtgttacaggataaaagcataaaacctgccattgtcagccctgcaaggcccattaaagttttcataatagatattaattgattagttagtatcacttaattgcttgatagttatatcaaccttttcattcttcttcagtttatctgaagtaataatcactttctttgtctgtcccggcaacaagtcaaagaagttatcagtaaatttcgcaccttgaacaggaatctctatgaacacatccctggccagctgtctggcagacagagtcacttcatattttccatccatcggcttcactttatagcggatctcggtcttcggtagctcctgatcttttgcgtggttaaagtaataaatttcttcggataaaacctcacctttcttgttttttaatgtcattagaagaaaagtattttgaggacttgttgttatacccgcataaggttccttataatataaggtggaagcattggccggaacctcgcccttgatactctttttagtcagaacttttccattaaaatccatcacacgcaacaataaagtcacctctttatccgcttccagcttgtccgacataacataaatattcaaatcctccccttccttgacagcatctaccaataccggagcaaaagctctttttgcctgataatgcaacgctttccaattgccataataatcaatgctcgaccaggaaacgaccggccagctgtcattcagctgccaatataaagtccccatacaatagggacggttacgacgatgggcttccaaaccctggcgcactcctaccccttgcaaaaccaaacccatataaaccaactgatcgaaatcttcaggtactttataatacagtcccatagtcttcttgatgaggaaattaccgatagtggctttttgatgagcattcatcacctccgattccaatgcataatcttccggtgaggcaaaagtagcaatcgtcttcatttcaggaaatgcctgaaaaccaaactcactcataaaacgcggaatttccgtatccagactttcaaacggtttctgaccataccagataccccaattatggctgtcggcaatcttccagctttcgggacgtccccaattggcctcgtacggagaaccatgcatatagaaacggtccggatcaagttcagctactttacgaggcaacaactcacggaaaagtttgtcataaccctgcttcattccttccataataccgggatcagtgtatttcttatcccatccccagtaacgcataccttcataaatttcattatttccacaccacatagccagactggcatggttccgtaaacgcttgatattatattccgcctcggcctctacccgtttcataaaagcaggatcggacggataagtagtgcaggcaaaaataaaatcctgccaaactaaaattccattctcatccgccgcctggtaaaaagcatcatcctcataaatccctccaccccatacacgaatcatattcatattggcatctttcacatccttgaacaactggcggtaacgttcttcagtaatgttaggcagcaaagcatcatccggaataaaattcgcgcctttggcaaacatcggttcaccattgactacaaaatagaaggattctccctgatcgtctttttctttcaccacctttattgtacggagtccgatacgctctttttgagaagctatcactttaccatccacctttattacggcttcaaagtcatacaatgcaggttccccccaaccattaggcatccataaatgaggctgccgtatctctatgggaagaagaatatggtttgttcctggctgcaatgtcacctctttctgttcggttaccttttcaccctccttataagaataagcaacggttacttccgctttctgaggagttgcagaaacactgtttacagtcaggaggttttcaactttcgccagatcttttgttaccgaagcctgacgtacatagtaatcatcaatgcgtgccacatcataaaaagtcagtgtcacaggccgccagataccactggttaccaatcggattccccaatcccagccataactgtaaggcgctttacggctatagatactgacccgcttatcactatggtcattatcagcaggataatcaaagccattggtttcccattggggcaacgtttgcttgacaggtgaatgaaacagaatctgcaaatggttttctcccttccgcaacacctcttttaccggaagagtatagccgacaaacatattgtccgtacgttccaacaaagagccgttcaggtaaatatccgcatacgtatccaatccttccaaaatcaacaaggcagcatcccgcgagagttgctcatctgtcacattaaaagtagttttatagacccagtcctcattctccacccactgcactttttgctcattcatcccataaaatggattgggcagtttattatgagaaatcaaatcctgatgtaccgttccgggcaccgtagccggcaaccattcattccggccgacctgggcgaactcccatcccttatcaagactcagactctctgacttcttatactcctttgcactgagcatcatcggaaagcatcctaacatcatcaaaacttttaatgttttcttcatcttacctatctttattaatttatatactattcagcccggaatgtggaagcaggcaaaccggcgccatttaccagattggcacgggtaaatggctgccatccgtaacgaaccgtttccggctctttcaccttatcactccatacttttattttaccgttttcaacaacagcctgtgccggataaaataatccatcatcacctgccacttcgaatgtacgaaccggtttcccatccgaagtggacaacttctccgcataatcaaaagaaatataagccgcacctccactaaatacgactgatttataaagcggtcccgaaggaatgacatttttatatccgtatgttttattcaaagcccatgcagccaaccgttcaccgacttctcttttctgtttggggtgtacgtccaatgagtctcccctatctgaactgacagccataccggtatgaggaatctccgccatcaaacgacgctggctatcacggaaccaagtccatgacggacggtctatactggacaattggacaaaatagaatggaagttccgcatccccccaattcttgcgccaactttccaccaacaatctgaacaacttttcatgagtctcccgattatgggcattagactcaccctgataccaaataaagcctttgaccggaaactgttccaaaggacggatacccgattcatacaaataacaaggctcataaggatggcgttgcaatttattgaaagacttctttacattcaaggcagcacgcccacgcacccagtcttggataaaatcattctgcatccaattacgtaaaatagccggaaaacgatattccaatgtgctacggtctatccatgcttcagtaggagatccgccaatggcattgcaaatcagtcctacagggacttgcaaactatcctgcaatttctttccgaaatagtaagccaccgccgaaaaattaccggctgtttcaggcgaacaaactgtccaccgtgtatccttataatattgcagatgattcaatgaatcgagtaccgaagcatcccactccaccgcatccgtacgccaacgggctttcatatcataaaaacggatattgctatttgcagcttgaggaacatcttgtgcggcagtcgcactccaattcagataaaactccatattcgattgtccggaacagagccacacttctcccgccaacacattttcatagaccagtttccgtttttctgtagaaacagtcagtgtatatggaccgcccgccttcaatggccggacatccaccgcccactttccatctgctcccgtcacagcctgaagttgctgcctgtctatggaaacagttactttctcaccggcatccgcttttccctgaatagtcagcagacgtccatgctgcaataccatattgtccgtataaatttccggcatttgcaaaccgccaaaatcaccggttatgccttcatacaccgtttttgccaagacagccgcaccttccttatcgggatggacagcatcgggcaacataaaaggatatggatataaaggtgcatgaaaatctatcaactgtacttgtgcgtatttcgctatcgtttctatagccagctgaatctcatcatgccagtcgcgtgtgccggactcaaaccgcggatggcggtcggcaatcggagtcagacgggcaatcaaaatacgacattcaggattcgccactctgaacgaatcaatcagtgcacgataatccgctataaaaaaatcacggtaattgggccaatcacgcggatctgtatcattcactcctaaatgaataaccactacatcaccagcaaaagccaatgcatccttaaactctttctgttgcataaaaggccggtgtcccttgttcagcaacgtagctcccggctttccaaaacgctccaccgtatacccttcacccagcatttgctgtaaccgggcaggataggactccttatcaggatcggatacacctatgccataggtaatgctattacctacacaagcaaccttcacccgcttccgtgcaaatgaaacggtacaaagaaacaaacataaaatcagtattaatgtcttcttcatttttggtcaacataaggttttacaatatcacgccacagcaagtatccctttcctaataaatgtaatccgtcattagtatatactggattcatcttgcctgtctctttctccacaaaatgactatacaaatcaatataggcagctccttcctttaccgccaatggttccaacaaatcattaatttgttttaccatctgccagcgtgatgtatgcccgttaaacataccgtaacaatcattcaccggcaatacactttgcaaatataattttgtttttggagattcttgctttattttccgaacaatcatacttatttctgaaataattttatccgcagacgttccccgagaaacatcattgataccgatcaataaaaaaatctttgccggttttccctttacaatcggatccaaacggtcatatacccccatacagatatctccactgatacccctgttcttcacattcttattttggaacaactcagcccactcgcaaccgttggtaatactgttccctaaaaaaataatatcttttgaagtaaccggaagttcttcaaacaaagtcgctctctgctcataaaaagtagaatacttgcgttcctgagcaaactggggtaacgctaataataatcccaataacaataagacaatacgtttcattttatttttgtttatctggtgaataaatcaatccttctaccgccctttctccgtcaggagtcacaaagacagtggtaaacatccatttcacaagacgcgtctcagccatcttaaacttaccgataggtaactttaagaaaactttgttccaacctttatttaaatgcaccgccaatggagatcttcctacgcaattctcatttcccaaaggtacttcataacttttcaccttatgcgtagcagtccatacaggaggtaatatttcgcaaccattaatccagatgcggcttcccttataatcccatttgccaggcaatggcgccagatccatttccgaacgactgtaattctggaattccacccacagtcccacctcctgatccttgggcgaatacacccaagtatatgcataagccgtgtggttttccttaggatcagcataaaaagcaggaaccatatccccccagacatgacgcaaataaatacctgcccccattgcctgacgtacaccatacgtattcccgttataatgatagatatcctttaattcctgttcaggcgggaacaccttatccatatcgcccccattaggaaaagcatccgtaatattccattttacattagtctgttttacataggcgaaaggatatcctttaaacgtatgctccttatgccacaacatacgcttttcaaaatcagcgaattctttaaatgcttccgtgtcttcggggggaagtatcgtacccagtccgtcaaaatattccgtacctccccctctccaggcacgctcggcaatagcaagcacattggggtacaagccattttcaataaccagattccactcattgtcaatcaaacgatcgtgccacaaagccaatatagttcccgcaatgtcctcactgccttctgcctgatcataaatacggctgttatacaaagctacaatatcaccgaaaacatcaaaatgattcagataatgaaatttggaatcgatagcaggaatacccggttgcgcctttccacggtaactccacaaatgtgtcatgtctatttcccccggtttatagtgccagcccggattccaggatattacttttttcccttttgagcgtacatacgccaccatttcgggtacaaaatgcggattggtaaactccacctcatctgtacctatatgtaaataaggcacatcaaatgtctcacacacctcatccagtaacagtttcaatattttcatcccttccggactttgcatatcatggcggaaagcacgcacaaaggcagcactatgccctggcatatctatctcaggaatcaacaacacctgatgtttcttacaaaaatccaccaaatcgcgtgcctcttccagcgtataatatttacccggcatacggatagtattcacactatcattcagcataggaaaaattttactttccaatctccatgcctggttttccgtaagatgccaatgaaatacattaatcttaaaccgggataaaatctctatctctcttttcaattcttccattgaaatataactgcgtcccacatcctgcataaatccgcgtatcctgaatgccggccagtctacaatctcacatccggcaacagagcttcttttcccttttttctgctccaattgccgaagtgtctgcatagcccaatacacaccctgttctgttacagcctctatctttattcgcttgtttgaaacagaaagacgataggcttcatcccggtttaacctagcttcatcaatagacggaaccagttccacttcaatcaccgatgatgagtgttcaacaatctcaccacccgcattcatgataaaaacttcccactccggccttaataccggagtagaaagtttcacctttcccatagtaaagttcttccccgtatccttacacaactgaggtttaggaagtaatgagatactggtttgtgctatggttatagcacaaaccagtatcataccaataaaactagaaaaccagcgtttcattatttatttggtctttacaatatctttcaattttatcgcttggaaagtcatgtgggccacactgctttcatataaaatccctactgtttccttgtcaatcatagttaagcagctatatccccaaccccaaccggcatccaacaacaattgattctcgggcaaccaagtcaccccgccatccagacttgctttgatggtaatgctatgacggtttttggtatcattcggattagagaacaaaagaatgtctttacctaatacattctctttagctttaacactaatcaaactggccatacaaaccggttcctgtaaggctgtacgtgaagattcatgttctttccacgttttacctaaatctgtagttgtagaaacggcacgactgccgccacgattatcacgcatattcagcatcagcactcccggttccacttccactacctgagattcagtagtattagtgcgtgccaatgtgctgatattccatgtctttccatgatccttactgtatataacaccggcattaggaatacgatcactgccaatatactggctggcaaagaccaatgttccatcttccatagaaatacctctaccgggaccttgcagcaagaaataccatgacggatctttcacctgttctgttatattcataggctccgaccaggttttaccatcatcatcacttttcaccatcattaattgcgctgtatgattacggtccatacctgtttgtgaattccaccacgcacgaccattccccataccatgtgtccaggcagcgacaatccagatagttcctgtctttttatcaactaaaatggcaggatcacctactccattctgtgctttaggcagaccatcatattcaccaaatgccatcggaatgcgcattttctcccaagtctgccctccgtccgtacttctgctcagacctatttccacatactcctgtaaatccgcactattattatagcgtacatcatatacccccaacaaggttcctttatttgaagtgaccaacccgggaatacgataggcagcagccccgtcatcaccggcatggcgcacgcctacccccatataatgggtatccgccttacgaactatcttcaaaggagcaatctgtccgtcaatcttagcttccaccacttttgccgacactttagacaagatagaagcaataggcttcatttgcaggctaatccaaaaataattcactcccggaaacaatttttggtcagctttcaatataacctcgcgcttcggggcctttacttccgacttcaaaacggaataagaagtattggcagccaatgtttttcccggagtattattagatatataatctaccggagcaaaataagtctttcctctcctctccacgctttcagttccaccataataaagtttcacagattcaatttcatttaaattcacgtctttgccgaagtccaacttcacttcattcagcatctgactttgagcagcctctatacgtaaatgaaacaactcattatcctgcctttcaatcaacacaggaatccgggtttcgcggacagcaaccgtatctgccgccgcacttaacttgaagggtgctaatataaaaacaacaattagcagtaataagctagggtttctcataatatttataattttacgggtgtaaaaataaaagtttttattgaaattagaaaataaaaagacggtttctttattaatttcataaagaataccgtctttttatgcaattaaggatacttatcagacaaaaatttaataaccaaccgtctgtttcaacaatggattattagtaagagctccttggttgataggccaaagcagacgggcagactccgccggagtatagtcaagtacgtacgaatcgccaaaacgccgcaagtcataccatcgttttccttccagcataaattcaaacaaacgttcctgcagaacagcatccgccggatacttatcaatttcctgattggggaatcccactgttgaagcatcatacgcatcaccaaacgcacgctgacgcacccggtttatctctgtagccggatcctcacccaaaagcactttcgcctcagccagcatcaatagcaaatccgaatatctataaataggataatcatcacatctcacccgtgtacttccattcataactccccaatacttatgcggatacagccccaccaattccaactcgccattttccaccttattatatacatctttcaatgtaacgtcacgacgagtgtctcccggcagaaatttcttgaagttttccaatttcaccatcaggcgcatgataccgaaattattctcgacagacgtatttatcaaagtaccatccgcattatagaatttccctaaataatccgcctgcggaaacaaatcattatttccattccacaggttgtattcaaacaactcattatgaatggtaaagataatctctttattacctttattatcataagcaaacactccctggtaagtatccatcaagtccagattgctacggctgatattattctgtatgtcaaccaacgcattctttgctgtccgggcatctccttctcccccgtcacgatgggcactccacaaatatacatccgctttcagcatcaatgtggcagcctttgaccacagcgattttttttcctttatggtataatcaggcccaaaataacttaatgaagattctatatctttttttacctgctcaaaaatttcggcagccggagtcgccgcctttgccaatttacccacttcaaaacccaagctgggctcttccgtaaacacggcatctccccatgaacggtataactgatacatatagtaggcacgcaatccatatacctgtcctaaataatagttcttagcactttcagtcagaacatccgtatggagggtcctgctgataaacaaattcatctggttaatattctgatacaaatcaccaaatccgctgattccgggattctccgcattcaatgtattataaggaaaacgttccatcccctgggtggcttctccaccaaaaggagttcccccaaagacatcacttcttgcctcacccaataaaaacatattccacgaatggcttctgaagcgactatgcagtccaaaaacaaatgaatcaaactgttccggagttttccagtaattcaagtcagtgatatcgctcaccgggtccatatccaacgaagtacatccaccggccaacatagccgatgcggcaaaagccaacattaccttttttatgttcatactttctcttttttacatattaaaatgacaattgtaaaccaaacaaaacggttcttggtgtaggataacgtccattgtctataccaccacgaccatttgcctgaatatccataaccggttccggagaagttccatcatatccggtaatatagaataaattctgtcccgtaacatacacggacgcatcggtcaagaacaccttatttataagattcttcgggaatttataactcaaggttacctcacgcagacacaaataatcccccttttcatagaaagtagagttattattgttcagattcgttgtaccattattggaacgggtaatgttctttttcgcattctggtcagcccaataaaatttaggaatactagtttccgtattgttttcagaccacgaatttctgacatccttaatcaaattgaacgacccgttatactgccccaagattcttgctttcaaatcattgtaaatggtatgacctaccgcatagtcaaaacgaccatacaaagaccagtttttataattcagcgtagtagagaaaccacctgtccatttcggatagatattacccaccacctgacggtcgtatgagtttataatgttatcaccatttttgtcatcccacaatacatctccaggctcaataggcttccatcccggctttcctgcatattcggcagctttattcggcccatacaggttggcaacttcatccacaaaatcaccggcatggtttctcacatcatcccagtcacgcaagatacgcacttgtttataagcaatgatatcacccaagctttttccttcctgaataccgcctacccaaaccaatgagttggattttggatcccatatctgctcacccccctgacggttgttcacattcccattaaaaggcagcttcttcaccatattcttcacaaacgaagtattagcggtgacatcccatgaccagtccttctttgtcagcagattcaccttggcttccagttcgaaaccacggttactgatagtacctagattcgttttgaacgaagggaatcccgtatattccggcaaattcacatcagtcagcaaatcggaagtcgtacggttataatagtccataatcatgtgaacccgattattgaaaaagcccagatcaagacccagttcaaacgtatgactcttttcccaacgcaatttactattaaccactccggtattcaaataacccagattaccattataagcacccaccgaaccgtatttaccatatacatcaaagttaccaataccatttacattcccgttcaacccatagctgatacgcggtttaatcaaggatactacttccgcaaactttgaatctttaaagaaagcttcctcatgcacattccaaccggcggatatacccggaaagaatccccaacgattgtcagatagtttagagataccgtcataacgggctaccaccgacaccatataacgataattataatcataattaacacgggcaaaaccggaaagaatacgataaccggtcttgatggaagtagtataagtacgattagtacccgcattcaaagtaggtatatcatctgtaggagcaccggagacacgcgcctccaagttctgatactgataatcaaaatactcgccacctagcatagcattgatattatgtccgctaaaaccttttttatattccaaagtcaatgcatgttgttgttgaaatacttttgtatttgtttgcgaagcattacgattggtgttaggagcctgacctatctgctgatacttcttttcgaacaattcaaactgataatcggtataatacatagagctgtttccgttcagaaacaattgctgcggaataatttctaaagcaaaaccaatattaaacgaagtcttacggttcgtcgtagaacgagtcagcttatctttccaataataaggattaccatcctgattactccatccggcagcaggacttccatcctcattccacgggttccaagtgggaaacatactcatagtacgatagaacaactcatactctcccgtttctccattccaagggcttttcagatcgtaagtccataaatcgggcatcttagaccatgaaaaactaccaccggcattcactgtcaaaacgggcaacaacttgtatgaaccgttgatagtcccgttcacacgctgataattggtggaaataatctgaccatcttctgaatagtatcccaaagatgaagaaaatgttcctttgtcattacctcccgacagattcaaataatgatcttgggtaaacgcggcattacggaaagtcaggtcatgcagttcaccggcatgatttctaaaaatcaaagttttatcaggatctgtagggtccgccataaattgccatccttcattcaataaatgcttgttggcctctgtcatgaaagccagatccactccggagttaactccaaaacctttctggttctccatacttgtaccgccattggtacgctgccatcccaaacgttgataatacaaatagtcaccggcatccagatatttatatccttcacgcgcaaagttcacaccgcctttgaacttgtaagtaatctgtgttctgccttccacccctttcttggttgtcaccagaatcacaccattattggcacgggcaccataaatagctgtggaagccgcatctttcaacacctgtatggattcaatatccgaaggattgatatcatccatagaacgcacaaggccatccaccacgaccaacggaccttccagattcttgtttatggaagcaccaccacgcaatacgatattgggcgaactacccggtttacccgaagtatttgtcacacgcagcccactgacagtcccctgcaaggattgagccgcattactcatagccgcattctgcaacactttatcgtccaacttcgaaatagagttcgtcatcaacgaacgtttctgactcattccataaccagtcaccacgacctcatccagcatttctgcatcttcttttaaaacaaccttgtagatgtttggcactcccacaacaatttgttgtgttttgtagcctatataacttacatccagtttcgcccccacaggtacttggatagtgaagttaccgtctacatcagttattgtaccatttgttgtccccacctccaggacactcgctccgataacaggttcaccagtggcatctaccactacccccgttatcgtttttgtttgcgccatcatgtttattgcaaaacagaggcatacgataaaaaagagagctttcttcatgaatctcagatttggttgataaattaatgtttaaataaaaaagtttaattaagcgttagttttaaaacacctcaaaaagaaaataattttaaaatcaacagcgaatatatgcacgcatatttagtatatacaaggaataaaaggaactatatcctttattagtgtttgttttttagaataaactaaatattaaggcatattttaaaaagttacataagggaataactcaaaaaagaaaaaaaagttcatacggagaagatataacaagaaaaacctccttgcaattctttgcaaagaggttactgaattgtacacccgatgagaatcgaactcatatcgtcggaaccggaatccggtattctatccattgaactacgggtgcgtctgaaacttggacgtgcaaaagtacaaaatatattgtctttctcctaataatttgagatatttatctatcaaaataatattttgcacattaatttaagaacaaaacaatcaatttgattatatttttgcctaaatatataacaatatcacaaataatttctatatttgcaagcaattaaaacaattagatctattttacaatgagttacctaattaaaccagctaactataaagccttgcttgatttaaaacaaacagagttaggcattaagcaaataaaagagttctttcaacagaacttgtcgtcagaattacgtctgcgccgtgtcaccgccccgctatttgtattgaagggaatgggtatcaatgatgacttgagcggaaccgaacggccggtatctttccctattaaagacttgggagacgcacaggccgaagttgtccattcattggcaaaatggaaaaggctgactttggccgattacaatatagaaccgggttatggcatctataccgacatgaacgccatccgggctgatgaggaattaggtaatctccactcactatatgtagaccagtgggactgggagcgtgtaattaccaaagaacaacgcacagttgatttcctgaaacaaatagtaacccgtatttatgcagccatgcgccgcacagaatatatggtatgcgaaatgtatccgcagatcaaacccttcctgccacatgacattcatttcatccactcagaagagctttgccaaatgtatcccgacaaaactccgaaagaacgcgaacatgctattgcgcaaaaatatggtgctgtatttattataggtataggatgtaaactgagtgacggtaaagaacatgatctgcgtgcacctgactatgatgactacaccacaattaatccggaaaccggactccccggcctgaatggtgacttgttggtttgggataaaatattagaccgttctgttgagctttcctctatgggtatccgtgtagacaaagaagcgttactccgccaactgacactcagcggacaggaaaagcgtaaagaattgtacttccacaaacgcttgttggatgaaactctgcctttatgtatcggcggtggtataggacaatcacgactctgtatgctttatttacagaaagcccatataggtgaaatccaagccagtatatggcccgaagatatgagaaaagaatgcgctcaattgggtatgcaacttatttgattataatctatcagcaatcgaagaagagggtgatacaaaagtcatcctctttttatttgtcatttttacaaataacccctatctttaacgcacatttttaataaaaagaaagcctatgaacgtacaaatagaagaaagctggaaacaacatctggcacccgaatttgaaaaagattactttatcaaactcacagagtttgtaagaagcgaataccagactaccactatttacccaccgggcagatttatattcaatgccttcaatctgtgcccgtttgacaaagtgaaagtcgtcattatcggccaagacccctaccatggtcccggccaggcgcacggactctgcttttccgttaatgacggagtaccttttcccccttccctacaaaatattttcaaagaaatacaaagcgatttgggtgctcccatccccacttcaggcaatctgacccgctgggcgaatcaaggagtattattactcaatgccacactgacagtccgtgcccatcaagcaggctctcatcaacgacggggctgggaggaatttacagatgccgccatccgtatactggcagaacaacgtgaaaatattgtattcatcttatggggatcttatgcacagaaaaaaggagccttcatagggacattcattaaatattacaaaatcagccaactaattcatacacaaagtatttgggctattctttttgaatttattgaagaaagaaagtgttaaactcaaaaaaatatcttctaagaatatggaaaataaaattcaggagcttaccgataagatttatcgtgaaggtgtggaaaaaggaaatgaagaagcacagcgacttattagtagtgctcgcgatgaagcagcaaagattgtagaggatgcccgtaaggaagctgagtctattctcgctgtggctcggaagtcagccaaggaaactgccgaaaatacacaatcagaaattaaattgtttgccggacaagcagtaaatgcattgaagaccgaaatagctaccttgttgaccaatgaggtagtcagtgaaagtgtgaaaggatttgtggcagataaggagtatctgaataagtttattgtttcattagctgcccaatggtctgctaacgaatctatcgtgatctctaccgcagatgccgaaggacttaagaaatattttgcagcgaacgcaaaagctttgttggataaaggagtgagaatagaagaagtgaacggaacgaaatcactttttactatctcaccagctgacggctcttacaaagtgaacttcggtgaagaggaatttgaaaattatttcaaggatttccttcgtcctcaattagtagaaatgttgttttaaaacgggactatgacaaattattattgcctggtagccggtttgccggatctttcgttggaggatggcaaactgaactatacagtggctaattttaaatcggaaatctattcggaattatcggaaaaggataggaagttaatcgacttgttctatttgaaattcgataatgctaacctgttgaaactgttgaaagataaggaagctgcgacagattttgaggggaattattctcagaatgagttgctggcgcttatcagttcggtgcgtgaaggcgatgctccggataagagatacccatcttatctttatgaatttattactgcttatttggctctttccgcagaggaactctatcgtgcggaagatatgttatctgcctgctattatgcgtatgccatgaactgcggtaatcaatttgtttcctcctggtttgaatttaatttgaatatcaataatatactggctgccttaactgcacgtaaatataaaatggacgtatctcaggtagtagtgggcaagacggatgtgagtgagatggttcgtacatcgaatgcccgagatttcggtttgtccgaaatactggaatattttgagcaggtactccgtatcagcgaaattgaagaattagtggaaagggaaaagaagatagatttgttgaaatggaactggatggaagacgctgtctttttcaactattttactgtggagcggattttcgtgtttttgttgaaactggaaatgattggccgttggatttctatggataaggaaaagggaagcgaactgttccgtcagattattgataaattgaaggacgagatacagattcccgcagaattcagataataaacagattaaagatatatggcaacaaaaggaactgttagtggcgtaatagccaacatggttactcttaccgttgacggaccggtggcacagaatgagatttgctacattctgactggcggagaccggttgatggcagaggttattaaggtagtaggcagcaatgtttatgtgcaggtgtttgaaagtacacgtggattgaaagtgggtgctgaagccgaatttacgggacacatgcttgaagtgactctaggtccgggtatgttgtctaaaaattatgatggtctgcaaaacgaccttgataaaatggacggagtattcctgaaacgcggacaatacacctatccattggataaagaaagagtgtggcattttgtaccgttggtgaaggtgggtgatgaagttggtccatcggcttggttgggacaggtggatgagaacttccagccattgaaaattatggtaccatttcagttgacaggtacttatgaagtaaaatctattgttcctgaaggtgattatactattgaggatactgtagtggttctgacggacagagaaggtaaagatattccggtaaacatgattcagaagtggccggtaaaaaaggcaatgactaattataaggaaaagccgcgtccttataaattattggaaaccggtgtccgtgttattgatacggttaaccccattgtagaggggggaacgggatttattcccggtccgttcggtacagggaaaacagtgcttcagcatgccatctccaagcaggcggaagcggatatcgtaattatcgctgcttgtggtgaacgtgcgaatgaggtggtggaaatctttacggagttccccgaactggtagatccgcatacaggacgtaagctgatggaacgtactatcattattgccaatacctcgaacatgccggtggctgcccgtgaagcgtctgtgtacacggctatgaccatttctgaatattatcgtgctatggggttgaaagtcttgctgatggcagattctacttcccgttgggcgcaggccttgcgtgagatgtccaaccgtatggaagagttgcctggtccggatgcattcccgatggatatctcggctattatctccaacttctacggacgtgcgggatatgtgcatctgaataatggtgaaaccggttctattacttttatcggtactgtatctccagcaggtggtaacttgaaggaacctgtaacggagaacaccaaaaaggtggcccgttgcttttatgccttggagcaggaacgtgccgacaggaagcgttatccggctgtgaacccgattgactcttattcaaaatatctggaatatccggaatttgaggaatatatcgccaaacgtattaatggtgaatggattggtaaggtgaacgaaatcaagacaagattgttgcgtggtaaggaaattgctgaacagattaatattttgggtgatgatggtgtacctgtagaatatcatgtaatcttttggaaatcagagttgattgattttgtgattctgcaacaggatgcttttgatgaagtggattcagtgactccgatggaacgtcaggaagagatcttgaatatggtaatcgacatttgtcatacggaattcaagtttgatacttttattgaggtgatggattatttcaagaagatgatcaacctttgcaaacagatgaactatgctaaatataaatctgagcagtatgaggattttaagaagcagttacaggaattggttgccgagagaagtgtctgattttaatttttaattttaatttataatgagtagagatggcaacaaaagcatttcaaaagatatatactaagattagccagattaccaaggcaacctgttcgctgaaagcgtcaggagtaggctatgatgagttggcaatggttaatgggaaattagcccaggtggtaaaaatcatgggtgatgaagtgactttgcaggtgttcgaaggtacggaaggtattccgaccaatgctgaagtcgtattcttgggcaagtcgcctacactgaaagtgagcgagcagttggccggacgtttcttcaacgcttttggtgatccgattgatgggggaccagaaattgagggacaggaagtgcctatcggcggtccgtctgtgaatccggttcgccgtaaacagccgtcggaactgattgcgactggtattgctggtatcgatttgaacaatacgttggtatcaggacagaagattcctttttttgctgaccctgaccaaccgtttaatcaagtgatggccaatgtggcattgcgtgccgaaaccgataagattattttgggcggtatgggtatgactaatgacgactacctgtattttaagaatgtattttctaatgccggtgcgctcgaccgtattatcagtttcgtgaatactacggagaatcctccggtagaacgtctgttgattccggatatggcgctgacagctgctgaatattttgcagtggaacataatcagaaagtgttggtgttgctgactgacatgaccagttatgctgatgcgttagctattgtgtctaaccgtatggatcagattccttccaaggactctatgccgggatctctttattcggatttggcgaagatttatgaaaaagcggtacaattccccgcaggtggttcaatcactattattgcggtaactaccttgagtggcggtgatattacgcatgccgttcctgataacacgggttatatcactgaaggtcagctgttcctacgtcgcgatagtgatatcggtaaggttattgtggacccgttccgttcgttgtctcgtttgaaacagttggtgagtggtaaaaaaactcgtaaggatcatcctcaggtgatgaatgctgccgtacgtttgtatgccgatgccgccaatgccaagactaagatggaaaatggttttgacttgactaattatgatgaacgtactttggcattcgctaaagattacgcaaatcagttactcgccattgacgtgaatctggatactactgaaatgctggatgttacatggggattgttcagcaaatactttaagccggaagaagtcaatataaagaaagaattggttgaccagcattggaaaaaacaataaattaatgaagaaacatggcaataaagtttcaatataacaagacctcgctacaacagcttgagaagcagctcaaggtccgtgtgcgtacgcttcctattattaaaaataaggaaagtgctctccgcatggaagtaaagagatgcaagacagaagctgccgggttggaggaaaggcttgaaaaacagattcaggcatacgaggccatgttcgcactttggaatgaatttgatgcttcattaataaaagtgagtgatgttcatttgggtataaagaagattgccggtgtacgagttcccttgttggaaaacgtagactttgacattcgtacttacagtctgttcaacagcccgaaatggtattccgatggaatacatttgttgaaaggattggcacagactgctattgaaagggaatttatgcttgccaaactgaacctgctggaacatgcgcgtaaaaagaccactcagaaagtgaatctttttgagaaagtgcagatacccggataccaggatgctctgcgaaagattaaacgatttatggaggatgaagagaacttgtccaagtcatcgcagaagattctgaaatctattcaagagaaaagaaaggaggcagaggcatgattacaaaaatgaagaagttgactttccttatttatcataaggactatgaatgtttcctgcaaagtgtccgtgacttgggcgtagtccacgtggcagaaaaagcgcaggggacagcggagaatgccgaacttcaagagagcatccgtttgtccgaccgctatgcttcaactattaagtttctgcaaggttttaatgctgaattgcaagaacaggagggagatgtagcccgtggagagaaagggctggaggaagtggaggcactacaactggagaaaacccagttgcagcatcagttgcaggtttgcgacaaagagcgtgccgcgttagaggtatggggagatttcgatcctgcatcggttatgcggttgcaagaagttggatatcaagtgaatttctatatttgctcagagaagaactttaatgaggaatggttggatacgtactatgctacggagattaaccgtattggctcacgcatttatttcattaccataaccaaagaaggatcgttgcccgaattggaagtggaatcggtcaaattgccagtaatgtctttgagtcggctcgctgccagatgtgaaagtttggaacagcaaatgaagagtgtggatgataagttggctgctatagcaggagaaaaacttctttctttgcaagttgcacaagccaatgtccgctcgcagatagaattctcaaaagtggtgctaagtacagaacaggctgcagataacaaattgatgttgttacaggggtgggcaccggctacgcagattccggagattactaattttctgaatcagcaggaggcgtactttgaaattgctgatcctacgccggaagacaatgttcctattcagttgaacaataaagggttctttcgtctgtttgaaccgattatgaagctgtatatgcttcctaaatataatgaactggatttgacgccgttctttgcccctttctttatgctctttttcgggctgtgtctgggcgattcgggctatggtctgtttatggtattaggagtgacagtttatcgtatgttggtgaagaatatcggtgcttccatgaagcccatcttaactttggtgcagattttgggtacttctactttcttctgcggtatgctgacaggtacttttttcggattcaatctatatggtaatgatattccgttctttaacaagatgcgtgatttgttcttcttggacaatcaatggatgtttaatctttcattgattttgggagcggtacagattattttcggtatgatactgaaagcggctaatcagattattcagttcggattgaaatatgcattgtcaactatcggatggattattgtattggtaagtacagctttggcattcctattgggagataccatgccgatgggaggaactgctcatttggtaattctggggcttgccggtgtgctgattttcttgctcaacagtccaggaaagaatattttcctcaatatcggtttgggtttgtgggattcctacaatatggcaaccggtctgctgggtgatatcctttcgtatgtgcgtttgtttgctttaggcctgtcgggtggtattcttgccagtgtattcaatagtctggcggctggaatgagtcctgataatgcaattgcaggtccgatagtgatggtattgattttcttgataggtcattctatcaacatgtttatgaatatattgggagcaatggttcatccgatgcgtctgactttcgtggagttttttaagaattcgggttacgaaggagggggcaaggagtacaagccttttaagaattaaagaatgagaataaagaattaaaagctgtataagctttttcggcattgtcattttgaataaatgttgtattcctgtgtagacagagaagccagaaagggagaatctgaagatagtatgcagatctttcgctaagttcaggatgacatgaaaagtattccttttaggaggagtttgataaaataaagaatttaaaaattaaaaaatagaagaattatggaaatgaatttattgattgcttatgtaggcatcgcaattatggttggtttatcaggtatcggtagtgcgtatggtgtgactatcgcaggtaatgcatctatcggtgcattgaaaaagaatgatagtgcattcggtaacttcttggtgttgactgcgcttcctggtacacaggggctgtatggttttgccggttacttcatgttccagagcattttcggtgttctgactccggctattacaggtattcaggctgctgccgtgttgggttccggtattgctttgggacttgtagctcttttctccgctatccgtcaggggcaggtttgcgctaatggtatcgctgccattggtcaaggacataatgtatttggcaatacattgattctggccgtttttcctgaattgtatgctattgttgctttggctgcaaccttcttgatgggatctgcattggctgcgtaatcagattagtttttttatataggcggttatttcctgtttttatggaaatagccgctttttttattctaatgtaaggcagaaccttaaaaatatttattattgtagctgatatcagtattttttgtgaagattgttagagcgaaatgattgaatgttaattcagaaactgtctgaataacataaagttgcaaaaaaactttattatctcattgaaaatatgtacctttgcgaccgaattaagattagttaatagatggcaaaagaattgttagcccctgattatatcttcgaagcaagttgggaggtatgtaataaagtagggggaatttatacagtgttgtccactagggccaaaacactgcaggaagcattcaaagacaaagtctttttcataggacccgatttttgggcaggaaaggaaaaccctttgttcagtgaaaatgagaatctttgtgcggcatggcgtgaacatgctttgaagaaagatggactgaaagttcgtgtggggcgctggaatattccgggagagcctatcgttatattggtggatttttatcctttcttctctaaaagaaatgaaatatatggccggatgtgggagaatttcaaagtcgattcacttcatgcttatggagattacgacgaagcgtctatgttttcttatgcagccggaaaagtggttgaaagcttttatcgtttcaatttgaccgaaaatgatagagtcatttatcaggcacatgaatggatgacaggtatgggcgccctttatttgcagaaagcggtacccgaaatagctactatttttactactcacgctacttctataggccggtctatcgccggaaacaataaacctctttacgattacttatttgcttataatggtgaccagatggctcgtgaactcaatatggaggcaaagcattctattgagaagcagactgcgcatcatgtggattgctttactacggttagtgaaattaccaacaatgaatgcaaggagttgttggacaagccggcagatgtggtgttgatgaatgggtttgaggatgattttgttccgcaaggccgtacgtttaccgccaagcgtaagaaagctcgtgctgcgatgttgaatttggctaataaattgctgggcttgacgatgagtgatgatactcttattgtgggcacaagcggtcgttatgagtttaaaaataaaggtatcaatgtctatttggagtctttgaaccgattgacccgtgataaaaatttgaaaaaagaggtgctggcatttattaatgtaccaggttgggtgggggaccctcgtgaagatttggtggaacgtttgaaaagcaaagaaaatttcacaactccgttggagtgcccgtttatcacacattggttgcataatatgagtcatgaccaggtacttgatatgatgaagtatttgggaatgtccaattcggcggaatctaaggtaaaagtaatatttgtaccttgttatctggatggaaaggatggcatcttgaatttggaatattatgatttggtgttggggaatgacttgagtgtttatccttcctattatgaaccttgggggtatacaccattggaaagtgtagcattccatgtacctactataacaactgatttggccggatttggtttgtgggtaaattcgttgaagggtagatactgtgagttgaaagatggtgtgaaagttatccatcgctcggattacaactattctgaagtagcggatgttataaaggacaccatatcggaattttcgggattgccggaaaatgtaatcaagactatgcgtaaaaatgcggcggacattgcggaaaaggcattgtggaagcattttatcaagtattattatgaagcttatgatgtggcattgcataatgcacagaaaaggcttattatgaatagctaattaattattaataaataatttgagagacatgaaaatcaaagtaagtaatgcgaatactcctaattggaaggaagttacagtaaaatcacacattcccgaagaactgaagaagttggaggaaatggctcgtaacatctggtgggcatggaattacgaagcaacagacctgtttagagatttagatcctgtgacttggaaagaagtggggcagaatcccgttgctttattggaacgtttgagctatgaaaagctggaggcattaacccaggataaggtgattgtaaagcgcatgaacgatgtatatgctaaatttaaagcttatgtagatgctaagccggatagcaaacgtccttctgtagcctatttctgtatggagtatggtttgacacatgttttgaaaatctattccggtggtctgggtattttggccggtgactacttgaaagaagcatcagacagtaatgtagatatgtgcggtgttggcttcttgtatcgttatggatattttagccagagcctttcaatggatggtcagcagattgctaactatgaatcacagaatttcggtagcctgcctattgaacgtgtaatggatgaaaacggacagccgatggtggtcgatgttccttatttgaactatttcgttcatgcatatgtatggaaggtaaatgtaggacgtgttcctttgtatctgctggatactgataatgaaatgaacagcgaatttgatcgccctatcacatatcagttgtatggtggagactgggagaaccgtttgaaacaagaaatcttgctaggtattggtggtgtgttgctgttgaagaaactgggcattaagaaagatgtttatcattgtaatgaaggacatgctgctttgtgtaatgtgcagcgtttgtgtgattatgtagaaagcgggctgacatttgaccaggctttggaagtagttcgttcttcttctttatatacggttcatactccggttcctgcggggcatgactattttgatgaaggcttgtttggaaaatatatgggtggttatccacagcgtatggggatttcttggcaggatttgatggacttaggtcgtattaatccgggtgatgcaggcgaacgtttttgtatgtctacatttgcttgtaatacttgtcaggaagtaaacggtgtaagctggctgcatggcaaggtttctcaggagatgttctctggaatttggaaaggctattttcctgaagaaagtcatgtaggttatgtgactaatggcgttcacttcccgacatggagtgctactgaatggaagaaactatatgctaagcattttgctcctaacttcctggaagatcaatctaatgagaaaatttgggaagctatttataatgtagccgatgaagaaatttgggaaacccgtatggctttgaagcacaaattggttgaccatattcgtaagcagttcagtgaaagctggttgaagaatcaaggtgatccttcacgcattgtttctctgatggaaaagattaatccaaatgccttgttgattggttttgcccgtcgttttgctacttacaaacgtgcacatctgctgtttactgatttggaacgtttgtctaagattgtgaataatcctgattatccggtacagttcttatttgcaggtaaggctcatccacatgatggtgcaggtcaagggttgatcaagaagattgtggaaatttcccgtcgtccggaattcttgggcaaaatcatcttcttggaaaattatgatatgcagttggcacgtcgtttggtttcaggtgttgatatttggatgaatactcctacccgtcctttggaagcttccggaacatcaggcgagaaggctttaatgaatggtgttgttaatttctctgtgcttgacggttggtggctggaaggttaccgtgaaggagcaggatgggcgttaactgaaaaacgtacttatcagaatcaagatcatcaagatcaattggatgctgcaactatttacagtattttggaaaatgagattcttccgttgtattatgcacgtaaccgtaagggatattctgagggttgggtgaagactatcaagaactctattgctcaagtggctcctcattatacaatgaaacgtcagttagacgattattatgctaagttctatactaaagaagcaaaacgttttaaagaattggtagccaatgattatgcaaaggctaaagaactggctgcttggaaagaacgagttgcagaactttgggattccattgaaatcgtttcatgtgaaaagacagaagagctagctagcggtaatattgaaagcggaaaagaatatatcattacttatgttatagatgaaaagggattggatgatgcagtaggtattgaactggttaccactttcaccaatgcggaaggtaaggagcatatctattctgtagaaccaatggaagtaattaagaaagaaggtaacttgtatacattccaggttaaacacagtttgtctaactcaggtagcttcaaggtggcataccgtatgttcccgaagaatgttgatttgcctcatcgtcaggacttctgttatgttcgttggtttaattaatcattgaattaagataatatttctatttaaagaactgtttccttggaaaagagaggaagcagttcttttttattagtctgttcgcccaaagttctattgatattatcattctagtttttgtctaagccgagattgctatggaaagtgcgtattattgggaagggtgacaggacgagtataaaaaataccgatgcctttctagacatcggtattttactttgtgaactatttttgcagttgttttatttcaacagttcgttcagcttggacttgatggcatcgccgcggagattacgtgctacaatggtaccctcctgatcaaccaatacagtagcaggaattgaattgacgccataaagttttgcacctgcattgttccaaccttgtaagtcagacatttgtggccatgtaatatttagggcagtgatagcctctttccacttgtctgcattttcgtccaaagaaacacctacaatcccgaagcctttatctttgaaagccttgtatgcttctacaacattaggcatttctttacggcaaggtccgcaccagctagcccaaaagtcaatcaaagtatatttatttttgctgacgaaatcagacaggcttacagtttcaccttcaggagtctgcatagagaaatcaatgtatttctgacctacagccgttttctttgaagtttcaatgtgggctttcaacttgttgatacgttcattaactaatgcggcaggaattttctctaccaacgctttttgtttgtcaagttcgaatgcgcctgcataggaaggaagcagatatacaccgaccggattggtgatattggcttcaattgtttgataaaccatatccatgcctacactgtctttcttttcaatctcagccatgatagcttctacctgctcttctgtcaagctagtgtcgctttgagccttttggtacatttcattcatttccttgcttaaagccatgaaaccatctttgaatttttggtaagcgtcattattaggagtacctgaaactttgctttccttacctaaggttacattaatattcccattttcaagaaaaagatcagtaaagtaacgcttgtttcctttcatataagtgatgtagcggtttacagccgtatcttgttttccggtgaatacgaaagttccgcttttgacaatagcggaatcgagttttacaagatcccctcctgcgtattcctgtaaatagattgtgtcgccatcagtgatgtcttctactgaacctgtaaccttataggaaggcgaattctgacatgcaacgaaagccatgcttcctgcagccaataaataaactaattttttcattttaatatgattataatttgcacgcaaagataactacttaattaatatgtttgcggaaaaaaggtttttattttcagaatgaaattaggaatctatagtttagctttgctttttttgaattttatgggcatttatttaattcctttggtttttttgcacaaatctatggaataaaaagtataatcctattagaccaatgttattagtgactatcatcctgataatattactctctcttgcattaatcaaagtaattgcaaaaggaaagttttttgattgtaaaataaagacagtagaacaatttcatgacgcgatatggaataatgcacatgagtttattttttttgatagaccagacttctcatgtagtgaaaacaaattattgtactctgtataagcaacctgtcaataaagacagaacttgttttggtgagattttacaatgctgatatgccagagagcaggaaaattgtaataagcatgaacggtgtaggggctgtcctgtccggtataaaataaaggaattgttcaatacccattcttcttttagtaatttggaggtcgtgatggataattgtttctcggccgtcgggtgtttataatatggttatttccgggcgctatttattgctggagaataaatattatgttattttaacagtgcatgatatcagtaaggagcgtgtgttgaagtcatctttgcaacatagtaatgagaaatttctttgtttttttgataatgtgaccgttgggtgtgctatttgcgacaaagatggcaagttggtggaagtgaatgatacttatgtgagatatatgggtaccacctctaaaaacgaggctgtgaatcagcttaatatttacaccaatccatgcataaacccagaatttaaagagataatgaaagcgggtgttcccgtatcggaggaagtgaagtatgattatgaaaaaataaataagtattatgtaaggagctgtcataaggatgtgcactattttcgttttattgtgaattacatgtggaatgccggaggagaagtggagaatattttaattatttgggtagagaatacgcttattcataaagcactctgtcagaataatatgttccgtgagataattacttatgcttcttctatttccaagataggcttttgctctcttaatttgtccaagagcgagcaattggtgacaccggagtatttaaagaatttggggataaaggaagaaatagacatgccccggattttttctaatttggaacatgcccatcctgatgaccggaaatttttccttgaatatatagaaaaagccggttatgagagaatggagccgttattcgtattatgacagatggagaatatcgttgggtgaagcaatatttaattcagcaagtttttgatctggagaacagaaatattgttctggcaggagtgaatgtggacattgacgtacaaaaacggacggaagaagctttgcgcatcgctaaagaaagtgcagaaagttccgatcggttgaagtctgcttttcttacgaacatgagtcatgagatacgtactcctttgaatgcgatagtcggtttctctaatttgctgataaatgctgacaataaggatgattttgatagctttaagtagattatagagcagaatagtacctttactgttacaattgatcggtgatattctggatctttcgaaaatagaatcgggcacattgaagtttgtatggagtgatgtgaatattaatgcaatgatatacgatttggagaaggtatttcaattacgaaacaaaaataatccggaggtggagatcaggtttgtgcccggtatggaagagtgcgtgattcgtaccgagcgacttatgggggggcggatcggtgttgaattcgagcagggagaaggttccactttttggtttacaattcctcaaaagcccatcattcactttgctgaaagaagagaaatagtacgcgcaatggaaaattattagtcggatgaataaatattactttatttatatcctccattcttgaaaaataccgtatttttgcaactcaattacaaaatgagtatgcaacaatctaattatataattgaggtaaaaggtgtttccaagttttttggtgataaaatggtcttggataacattaatttatatgtaaaaaaaggtgagtttgtaaccgtgttgggtccctccggctgcggaaagactactcttttacgtttgattgccggtttccagactgcttcggaaggcgagataaagatagctggaaaagagatcacgcagacacctccgcataagcgcccggtaaataccgtgtttcagaagtatgctttgtttcctcatttgaatgtgttcgataatattgccttcggattgaaattgaaaaagattcccaagcagactatcgagaagaaagtaaaggcagctcttcgtatggtaggaatgacagactatgagtatcgggatgtgaattctttgtcaggcgggcagcaacagcgtgtagccatagcccgtgctatcgtcaatgagccggaggtgttgttgctggatgagcctttggctgctttggacttgaaaatgcgtaaagatatgcagatggaattaaaagagatgcataagacattgggcatcacctttgtttatgtgacgcatgaccaagaggaagctttgacattgagcgacacaattgttgtaatgagtgaaggaaaaatacagcagatcggaacaccggtggatatttataacgaacccatcaattcgtttgtagccgattttataggtgagagcaatattttgaatggaacaatgatacaggacaagcttgtgcgttttgcaggagtggagtttgaatgtgtggatgaaggtttcggtgaaaatatgccggtagatgttgtggtacgtcctgaagattggtatatttttccagattcggatgcttcacagatttccggtatcgtaacctcatccatctttaaaggtgtgcattatgaaatggtggtcgaggccaatggttatgaatttattgtacaggattatcatcattttgctgtgggtgagcaggtaggtttgttgataaaaccttttgatatccatattatgaaaaaagaacgtgtatgcaatacgtttgaaggagaactggcagacggaacgcatgtggaatttctgggatgtacgtttgagtgtctgccagtggctgacattgagccgggggccaaagtgaaagtacaggtagatttcaaggatatcattttgcaggataatgaagaggatggaactttaaccggggatgtacgttttatcctatataagggagaccattatcacctcaccgtgtcatcggactggggggaggatatttttgttgataccaatgatgtatgggataatggtgatcatgtaggtatcagcatccttcccgaaagtataaaagtaactcaggttgtagaatcataataaagaaaagaggtgctcagaacgatacgatttttcttgtcttcacgtaaaagctggactattccttacgtgatattttcggcggtatttgttattcttccgctacttttaatagtggtttatgcatttatggatgatgcgggttatttcactttgggaaattttgccaaattcttcgctcatcccgaggcaatcaacacatttgtttattctattggcgtggccattatcacaacagtggtatgtatcttattgggatatcctgctgcctatattctgacacagacgcggatgaaatatgcatcgacggtggtggtattgtttattctgcccatgtgggtgaatattttaatacgtacactggctacggtagcattgttcgactttatgaacgtacctttaggagagggggctttgatattcggtatggtatataattttctgccttttatgatttatcctatttacaacactttgcagaaattggataaaagttatgtggaagcggcacaagatttgggcgccaatcctatgcaagtgtttttcaaggctgtgctacccctgtccatgccgggtattgtgagtggtatattaatggtgttcatgcctactatctccacatttgccattgccgaattattgacaatgaataatattaaactgtttggtactactatccaggaaaatattaataatagtatgtggaattatggggcggccttgtcgttgattatgctgttccttattggtgcgacaaccttgctcgcttcagatgataaggatcataacgaaggaggtgggctatggtaaagaaaattttgtgtcagggatatttgtggctgcttctgctattgctttatgcacctatttttatcattatgatctattcgtttaccgaagcaaaggtgctgggcaactggactgggttttccaccaaactctattcatccctgtttgttgcgggtacacatcattcattgacaaatgccttggtcaacaccctgagcattgccttgattgcagctaccgtatctactttgctgggcagtattacggcaatcggtatattcaatcttcgtacccgtgctcgtaaagcaatcagttttgtcaataacattcctatcttgaatggagatattattattggtatatctttattcttgctgttcgtatctttgggtattccacaaggatataccactgtggttcttgcacatatcacattctgtactccatatgtggtgttaagtgtgttgccgcgtttgaaacagatgaatccgaatatttatgaggcggcgcttgatttgggggctacccctatgcaggcactccgcaaggtgattgttcctgagattcttccgggaatgatttctggttttatgctggcggtgactttgtccattgacgattttgccgtgactgtatttactattggtaacgaagggcttgaaactctttccacctatatttatgcggatgcacgaaaaggagggctgactcctgaacttcgtccgctttctaccattatattcgtattggtgctggtattgttggttatcatcaatcgccatgcaagcaagaaaaaggaggtataaaaaatgaggaaaataaataaatggctgatggtgtgtgtgtgtgcgttattttctttaaccggatgttataacacagagcctcgtgaaaatgtactgaaaatatataattgggccgactacattgatgaggatgtgttggcggaatttccccggtggtacaaagaacagacgggggaagatatacggattgtctatcagacttttgacatcaatgaaatcatgttgaccaagatagaacgcggacatgaagattttgatgtagtttgtccttcggagtatatcatagagcgtatgctgaggaaaggtttattgcttcccattgatactgtttttggaaagactcccaattatctacataatgaatctccttatatccgcgaacaattggataaattgagtcggtcggggcatcgtgcttcagattatgccatcggttatatgtggggaacagcaggtatcctttttaataccgatcatgttccggcggaagatgccaggacttgggccagtctttggaatctgaaatataagaacaagattctgatgaaggaaagttatcgtgatgcatatggtaccgcattgatttatgccaatgctggggatttgaaaaaaagtaaggttacggtagaggagttgatgaacaactattcgcaagcgtccatcgatactgttgagaagtatctgaaagcaatgaaacccttgatagcaggttgggaagccgattttggtaaggaaatgatgactaaaggtaaagcatggctgaacatgacctggagcggggatgcggtatgggcgatagaagaggctgaaggagtgggcatccatctggactatgaagtgccggcagagggaagtaatgtgtggtatgacggatgggtgatccctaagtatgctagaaataaaaaggctgccagttattttattaattatttatgccgtcctgatgtggctttacgtaatatggacgcctgtggttatgtgagtgccgtcgcgactcccgagattttggaggcaaagatagatactaccttatcttactttgcagatttaagttattttttcggtcctgctgccgatagtatacaaatagataaagtgcagtatcctgaccgtacagtggtggagcgttgtgccatgattcgtgactcctgtgacaagaccgaattggtcttggagatgtggtcgcgtgtaaagggggataatttgggggtaggcgtggttattgtgattctggtatttgccgggattatggtggtattcaccgtgtatagaaagcttcagcgttatcagcatgaaaaggtgcaacgtcgtcgcaggaatcaccggagaaagaaatgacttaatctaaaggaaaacatttagtcttgctgataaaacgatttagggaatccaatctttaggtaaaattaaaataaaagtccgaacttgggaaagtccggacttttatttctataatcatataaagattaaatgatgtattgtgaagagatagactcattattcatcacgcggcggattgtttcagcaaacatatcggcaatggtcagttgcttcactttagaacaacggttagcataaggaatactatcggtaaataccatttcttctaggccggagttctgaacgcgttcagatgcaggacctgacattacacagtgagaagcgattgcgcggacggaaatggctcccgcttctttcataatatcggcagctttggtaatagtacctgctgtatctaccatatcgtcaattaagatgacatttttattttttacatcaccgataatttgcatggtggccacttcattggctttcaggcgcgtcttgttgcaaagcaccaagggtacacccaaatatttggaataagtgctggcgcgttttgaaccacccacgtccggagttgcgattaccaagtcttccagttgcaatgattcaatgtaaggtaggaatacgccagaagcgtagagatggtctaccggtacatcaaaaaatccttgaatctgatcggcatgtaaatccattgtgatcaaacgatcaatgcctgccacgctcagaagatcggctaccagtttagcaccgatggaaacacgaggtttgtcttttctgtcctgacgtgcccatccaaagtaggggataacggctacaatactctttgcggaggctcttttagctgcatcaatcattagcagcagttccattaagttgtcggagttaggaaaggtagattgaaccagaaaaacatgtgcgcctctaattgattcttcataagaaacagcgaattcaccatcagcaaaatgcatgatgttcatgtttcctaattcgcaaccgaggctgttgcaaatcttttctgcaaggtatctcgaatttgttcctgagaataccataaaaggtgatgttttgctcatttttgtaatagatattacctatttgttaatttgcgtgcaaaggtacgtattataattagaaattaaaaatagaaatttaaaaataacttctcattattgtaacatgtttggtgtgaagcatattcttcgttttttagacttctattctaaattttttgataaatcagtctgctaaatctcttaatttccggaaatgttctatcacgcatcggtaatcgcggtcagtacatgcatcgaatttattccaaagggcgcccaatatggcggctcctccgaaaccaaagtcctttacctccagcaagttttcttcgtcaatgcctcccaaagctatgactttcttgtcgataatgctcgctttggcggcggcacggagttcttcggcggtgtatgccgagttataattcaacttggatatactattgaataccggactcagaaatacataatcgcaaccagatttgtgctctttaacttcgtctagcgaatggcaggaacaactgacatgtcctttgtatccttccggcagattcggattacggccgttcaggtgaattcctttcagtttgtattcctctttcagataaaaatgtccgtgaaccacgatgcgtttgtgatattgttcggggataagggttagcagacgttctgcaaacataggtgccgtaccgggctttcgcagatggagtgtatctagcccctcctcgaaaagagctgtaattattttatcttcctccacaaaataagtggggggtgttattagaattaacttcataccttatgactaattgctaagcaaagatagcaacctatttgtaataatcctagtggatttatagatttatttttgataagcctgtaaatcaataggatactttccctgaaaatgtaattcatgcgatggaaaagttttaaataatgtgtgcgtacctgcatgaaataggcgttttttatttacttttgcgctaataaacaagacgaatagatagaattatgaataaaaaacaatttcttgcagctgcattttgcttgatggcgcttgccggatgtacgcaaaaaacggaattgcctgagaatcctaaagatcaagaagagtaccgtgatcatcagggaaacagttggatttacaacgctatgctgatgcgttgggcattaatgccgtctatggccaacggactttctaccacacattattattatcccaaatctgattcgtggacagatgctaacggaacgaaagtggatgctccttcaaaagtgaatgtggggtcaaaatcgtctgcaaaatcaaaatcgagcggaagtgtttttgggaaaacacgccgttcatccggtgttcatagttaacaggaagcggatatgaaaagaataccagttacgccacgtctggattaccgtgagaaaatagaagcgctggggtttgattttcatggtgattattggcgcgaggaagcatattatcattttacggctgaagaaacagcttgtttggaggaagcgaccaatgaggcgtaccacctgtattgtgaggctgcccaattcattattgaggataacccggaatttatggagcgtgcgttgaatattccgaaggagattggtgagcgtattcgtgcttcttgggatgcggatgagttaagtctgtatggtcgttttgattttatattagccaaggatggtactccgaaaatattggagttcaatgctgatacaccgacttctttgcttgaggcatctgttatccaatggcaatggaaagaagatgtttttccggaatgcgaccagtttaatggcattcatgaaggattggtgcagtcatggaaagatattttccccaaaaaaggagagatttattttgccggtgcattagagaataatgaagatacaggaacgttgcaatatctggcaagtacggcgatggaggctgggttttctacccgagtattagatatgcaggcgctggatttgcagaatggacgattttttgatccggcaggtgaactagtgaaccggtgctttaaactttatccgtgggagtggatggtggacgaaagtcctgacggatgtctggcggaaatggaatggttggagccgatatggaaattggtgatgtccaataaagcgatccttgccacattgtacgagttgtttccggattctccttatgtgcttccttgttatttgtcgcgccctcggtcgggtttgttttgtaaaaaaccggtcttctctcgtgaaggtcataatgtaagcgttgttgatatccggaattgggaggaacatgtacgtatagctgaaacggagggtgattataacactggagcttatgtatatcaggagtatgtggaaccgacagtgtacagtggcagatatccagttattggctcttggattataggaggagaggctgcgggcatcggtattcgcgaaaatcgtatggaggttacggataacttgtccgagtttgtaccacatattataggataaagtcaaactatttatgtgccagtcggagccgggcgacggatgtcgtcatgcctcggctgttggcacataattgaggaattaaatgtcttttgaatagggccggttcgattcctctaaaaagaaatgagatgggtttccatcgttttcacgttaatcgtccataatttgccgcttagcacttcgccatattcacctataatcttcaacacttcagcggcttcggcgcaacctatcatgccaggggttacacccaatactcctttgggtggatgaggcatggacagcatttctgcttcatcggggaaaaagtggcggtaatcgggacctccccggtaattgaagacggatacttgaccttcgaaggcgcggatggcgccatatacatagacttttccccatttcacacagatgtcattaatgaggtagcgggtagcgaaattatcacatccgtctataatgatatcgtaggtgcggatgatttcatccgcattctctttagtcagtcttgtgggataggcattgatttgcacatcatggttcagggcttcgagacgtttcttggcttggatggctttgggcatacctacctcggcttcactataaagtacttgacgttgcaagttgctgacacttaccatatcatcgtctactaatccaatggtacctactccggctcctgtcaagtacaaggcaacaggagatcccagaccgcctacaccgactataagtactttggcttgttgaagccgttgttgtcctttttctcccaattcagggagaatgatttgacggttatatctttccactttctttgttgttaagttgaaaaaggggctttgtatcattgatacagccccattcctttaaaaatatgggtaatatctatcgcattggtgtgaacttgtcaaaagaaacatcccagtctttccataccggttcccttcctaatgatttcagtgcgttttccacttccatagctgtacgttcatcgcttacatggaattgttccaaagcttgcggataggtatagtatcctcccggttcggttttgctttcagcgctcatggtagtcactccgagtcttgccatgttgtcgcggatttgtgccggctcacgggtggagtaggagatgtccacatcgtggtcgaagatgcgcatggcaaaagtgagctgcgccaattcacggtcattcatgatgacattcggctggaaaccaccgttttctgccggacgcatacgagggaagtttacactgtatttggttttccaatactttttctgaagataacgcaagtgataagccatcatggtcacatcggtgcgccattcttccaatccgatgagtacccccatgcctatggagtggactcctgcctgtcccatacggtcgaagctgtttacccgccactcgaatttggatttcattccgcgtgggtggtatatattataacgggctttgttgtaagtttcctgaaagcaaatgactccatttagtccgtgttctttcagttcggcatattcttcggctttgaggggcattacctctattttcaaattgctgaaatattttttggcgatgtccaaggctttggccagataagggactccggcttttgccggattttctccggtcactagtaataggttttcaaaaggaccaagtcttttgatggctttgtattcatcttcaatctgttcgggggtgaggatggtacgagccatcgggttgctgatatgaaaaccacaatacacgcaagaattggtgcaggagtttgttatatacagcggtataaacatggaaatggttttgccgaaacgttcttcggtatatcttttgcttagttgcgccatcggctctaggtattttgctgctgcgggggagatgagtgccataaagtcgtccacatcgcaatgttccttaccaagggcgcggagcacgtcatgttcggttttggagtagatggctttggtgatcttttcccaatctattttttcaagttcttctgaaaacatgattgttattttttcttgttattgttcataagatgattttgcttttataaaagtctgtttaagcctttccggcattttatcaggcttcaagctataatttccttattatttttctacatttctttttgtcgttttccgtcagttcgggatgttgttttgttcctcccttctggataacgcctttgatagagaatccgctccacttcagaatttcgcgcaacgcttttactacgccgcgtgtctggttaaaccagatattgaatggccatggggtggagcaggtgcttacgatgactgctttcttgcctttatgcaacgcttgagggagccctttcggactttctcccatcatgccgtacacgatgcggtcgaacactactttcatatgtccgttcatatttccccaatagcaaggtgagccaacgatcagcacgtctgcccattgtatcttttgaagcgtgtgctgcgcgtcgtcttcgggtaggacacaggtctgtcggctgcggcaagccatgcatcctgtacaggggtgcacctgcaatttacggatgggtattacttccacttcggcgccacgtatgcgggcttcttcggtcatgatgtccagcatttggctgataagtccttggttacgtgggcttccgttgagtatcaatatcttcatttccttattttttttaggatgttgttgcgggcacattgcacggcgaccgtatagtattccggttccatattttccaagtatgctttcagttctcctgtcagttccggttcttccaggcagatgtcgtaggcaagtttcatgcagacagcttgtccggatgcgctttcggcagaagacagcatgccttgaaggcagaaatcaaagaaagctgcgttgacaggctttgggacaggaagatgatgaaggatattcagtagcagacgtcttgttccgtcatgggggcattgcatgacccgcagcatcagtttctcccttttatccatcaatagggaagggaggaggatgctcagtttttcacaagcccaagtggcatgccaagctatctttgtttcttcatgctgtgtcagagtataaagagcatcaaagcggtcgggggagccggctacttgatccactatgttgtctatgtgttttcttcctaaagttccttcaagtgctttcttgaaatcttccatagttttcacaaagtcagctgtttaattacccacgttcttcaagtcgcggctcagtttcatggcgcagaagttggggccgcacatggtacagtactcaccgtccgtatggcggccttcattgaagtattccaaagcgcggtcgggatccagactcagatggaactggtcgcgccaacggaattcgtaacgtgccttgcttaaagcattgtcacggatctgtgcgcccggatgccctttcgccagatcggctgcatgggcggcaatcttgtaagtgatgacaccaacgcgtacatcttctttgttgggcaatcccaaatgttctttcggggtgacatagcatagcatagcagtgcccagccagccgatttgtgcggcaccgatggccgaagtgatatggtcatatcccggagcgatgtccgttaccagcggaccgagggtgtagaacggtgcattgtggcagtgagagatctggcgttccatgttttctttgattttatgcaaaggtacatgtcccggtccctcaatgaatgcctgtacgtttttgtcccatgcgcggagtacaagttcacccatggtatctagttcggcaaactgtgcctcgtcattggcatcagcgatacagcccggacgaagtccgtcacccaaggatacggctacatcgtattgtgccagaatatcacagatgtcgtcaaaatgctcatataagaaactttccttgtcatgtaccagacaccacttgctcatgatgctgcctccgcggcttacgatgccgcacaaacgtttgtcagccagatgtacattttggcggcgtattccggcatggatggtaaagtaatccactccttgttcgcattgttcgattaatgtatctttataaatctcccaattcagatcctctactttaccgtttactttctctaatgcctgatagataggtacggtacctacggggacaggacagttgcggacaatccattcgcgtgtttcgtgaatgttatcgccggtcgagagatccatcagggtgtcacctccccatttgcagctccacacggctttttccacctcttcgtcaatggaggaagtggtggcggagtttccgatgttcgtgttgatcttcactaaaaagttcctgccgataatcataggctcgctttcggggtggttgatattggcgggaagtacggcacgccctgcggctatttcatcacgtacgaattcaggggtgataaaggtgtcgatgcccagttcccggcaattcatgttttcacggatggctacatattccatttccggtgtaacgatgccagctttggcgtatgccatttgtgtgatggcctttccagctttggcacgatagggcagggcgatgtgttcaaagcgcaggtggtccagacttttatcgtcgcggcgcatctttccgtattctgaagtgatggagggcagttgttctacgtctccccgtccggtaatccagctttcgcgtatacggggaagtccttttttcagatcgatttccatattggggtcactgaatgggccgctggtgtcataaatataaacgggagcattgggcgttattactttttcaccgttcactatattcacagtaggagtcaggtttactttctgcattcctactttgatgtatgaaaacagggttccttgcatatatgccttttcggcatgagcgtatgctttttgatcttgctttttgtccatcatatttctgtttaatctaagaatgaagttaaaggggatgaggcagatgcgatcaagttctgtcctactgctcctaagcctgcttcataagcgcggcgtccggcaatgacagcttccttgaaggctgttgccatgactaccggctgaccggctactgcgatggctgtattgaccagacaggcgtccgcgcccatttccatcgcttcggcagcatggctgggggcacctattccggcgtccactaccacaggaacggaagcttgttcgataatgatgcgcaggaagtcacgtgtctgcaagcctttgtttgtcccgatgggggcggcaagcggcatgacagttgctgctcctacctcttccagccgtttgcacaatgtaggatctgcctgacaatagggcaatacgacgaaacctagtttgactagttcctcggttgctttcaatgtttcggtagaatccggcaacaagtagcgcggatcgggatggatttccagtttcagccagttggtgccaaaagcctcgcgggccatttgtgcggcaaagacggcttcttcggctgtgcgcacaccggaggtattgggcaatagctgtatgtgagggtgaatgatatgtttcagcatatcatcttccttatcgtccaattcaatgcgtttcatggctacggttaccatttcacatcctgatgccagaatggcttcttccattacggtatttgaattgaatttaccggttcccagaaataaacgggaattaaattctttttcagctataatcagtttcttcattgtattttgtgattttattataaattcatgattcgtttagtttccgctaccgggtctttcgcccggagtatggttccgctcaaagcaatgtcggtgattcccgtttccatgatggaagggatatcttccaaagtaattcccccgatggcgacgatgggcagatggatatctgcctctttcatttgctgaataatggaacggtaaccttctagtcccagcactggagagagatccttttttgtggtagtaaaacggaacgggccacagccgatgtagtcagctccagcttcgtaatgcatctttacatcgtcaaatgtattggcggtgcctccgatgatgaattcttttcctaatattttccgtgcttcggctacgggcatatccttttttcccaaatgcactccgtcggcatgaattttattgaccaactccacgtggtcgtctatgataaatgttgctccgtagtctttgcataagccttgcagacgtatggcttcccgttccacttcgtcaacggaagtgtctttcatacgtagctggatccagcggcaaccgccttccaaggccatgcgtgcggaatcataataggaatatgtgtcggtgaagtgagtgatgaattgaagttccacggtcttatcctccacatgcagctttaatgactaccagactgtcattggggtgtaacacacatttctcccactctatacgggggaccatccggttgtttaccgctatggcgatacctttctcaggaagtgtcagaaaggtggaaagttcggctacggtgcatccgtcctttacttcggtttctttgctgtttactgtcagtttcatactataatatcagtttatgaatttacttgtaaatacaaagagttgctttttgaccggatggtatgaggtaagaagtaacaatcccttcggcggtactaaccgcatcaggttcacagggtataatctcagcccgtccgctgtttacgtggggcacccctttgttttacgatggcaaagatatgggaaagaaatgaataatgctacaacagactgctttattttttgtggaagaatgtttttttatgattatcttgcattgtgcttgtttattcttgtaaaaggatgaatgcatatctgctgtatctttgcatcttaaagcagattgccccgctccctgaatgaataggggcgaggcagccttattatgatgtatagttaagggtccttttatagacgtttttctactacatcccagtcaatgatttcccataacttgttcacatgatctgcacggcggttctggtaatccagatagtaagcatgttcccatacatcgaaacccagcaatggtttcagtcctgcacgccacgggttgcttccgttaggttctttggtgatatgtagttttccctgcttatctacagaaagccaagcccagcccgaaccgaacagtcctgtggaagcggtgttgaattctttcttgaagttttcaaagcttccgaagtctcggttgatggcttctgctagttttccggacggttcatgcttgctgggtttgggggtgaactgaaggaaatataatgtatggtttaatacttgtccggcgttattgaatatcgctccgtcgggagctgatgtaacaatttcctctacggactttccttcaaattccgtacctggaactaaagagttcaaattgtttacatatgtttgtaagtgcttgccataatggtagtctatagtagcctgactgattacaggttcgagtccgttatttgcatacgggagttttggcatttcgtaagtcataactaatgaaattaaagtggttaataatatattcatttttagtcgaggttttaattaaacttctatcataataacattattgggcatggaattgttctgataaactcaaactttctctatctttgcaggcgaaaggtgaaatttatgacgaattatttagaagaattgaatgaaagccagcgcgatgcagtgctttacaacgagggtccctctttggtgatagctggagcaggttcggggaaaacacgcgtgctgacttataagatagcttatttactggagcagggatatactccttggtctattttggcattgacttttaccaataaggctgctcgcgaaatgaaagagcgtatagcccgtcaggtgggcgatcaggcacgctatttatggatggggacgttccattccattttttcgcgtatcctgcggtgtgaggcacaggttatcggctttagctccaattttaccatctatgattcttcagattcgaagagtttgatcaagtctattgtaaaagaaatgcaattggatgataaaacctataaatcagggttgatacaggcgcgtatcagcaatgcgaaaaatcatttggtttttcctgatgcatatgtttcgaacgcagagctttatcagtatgatttgaatgccaaagtacccgccacccgtgatatttaccggcaatattgggaacgttgccgtcaaagcgatgcgatggattttgatgatttgctgctttatacttatatgttattccgcgatcatcctgaaatttgccgtaagtatgcggagcagtttcgttatgtgctggtggatgagtatcaggacaccaattttgcgcaacacagcattgtgcttcagcttacccaggagcatcagcgtgtatgcgtggtgggggatgatgcgcagagtatttattccttccgaggggctaatattgacaatatattgaaatttactcaactgtataagggggccaagctttttaaactggagcagaactatcgttctacccagaccattgtgtgtgcggcaaacagcctgatagagaaaaatagcgagcagataaagaaggaggtattttcagaaaaagcgaagggggagcctatcggagttttcaatgcctacagtgatgtggaggaaggggagattgttgccaaccagattgtgaaactgcgttcacgggaacattattcttataatgattttgctattttataccgtacaaatgctcaaagccgtattttcgaggaggctttgcggaagcgtagcctaccttataaaatttatggaggactttctttttatcaacgcaaggagattaaagacgttatttcttactttcgtctggcggtaaatccgaatgatgaggaggcttttaagcgggtattgaattatccggtgcgaggaatcggggatactacgttgaacaaagttattgatgcggctgcacagcatcatgttagtctttggatggttttggaagagccgttggcatacggcttgaatattaacaaggggatgcataccaagttacaggggtttcgtgaactggtaaaaagttttatagtggagatcccgaaaaagaatgcatatgaattgggggcaatgattgttcgtcagtccggcattatgaatgagatttatcagagcaatgatccggaaaacctgagccgtcaggagaatattgaagaactgataaacggtatgcatgatttttgtgcaatccgtgaagaagaagggaatgagaacatcctgttgacggatttcctgtcggaggtttctctgctgacagaccaggataacgagaaagaggaggatgctgagaagataaccttgatgaccattcactctgctaaaggcttggagtttaaaaacgtttttgtagttgggttggaagagaacttgtttcccagtgctttgtcactcaattcgtataaggaattggaagaggagcgccgcttgttttatgtggcgattacacgtgccgaggagcattgctatttgtcttttgccaagagccggtttaaatatggaaagatggagttcagtagcccgagccgtttcttgaaagatattgatgtacatttcctgaagctgcctcaggaggaacagatggcccggagaatagacgagagagccagccgtttctgtcgtgagcaaaatgaacgtgcgtctcgtttcttgtttgacgaatctgcttcgcagccttcttatgggcgttcttcatcaaatttgtctggtggtcagaaatcattttttgttggagaaagaccgaaagctgagattatccgtcccagtgtgccgcgcaatttgactaaggtaggtcttgctacggtctcaaagccgtccgcggcgggaaccttgccggtgaatgtgctggcagggcaggtgatagagcatgaacgctttggaataggcgatgtgataaaagtggaaggaaccggtgagaacagcaaggcgactgtccgtttccggaatgccggagagaaacaattattgctgaaattcgcccggttcaaagttgtggaataaatattctaatagaattctgatacaaaaatgatagatatccataaagtaccttctccatgctatgtgatggatgaagcattgctcagaaagaatctgagtttgataaagagtgtggcagaccgggccggagttgagatcatcttggctttcaaatcttttgccatgtggaaatcatttcccgtttttagggaatacatccgttatactacagctagctctgtatatgaagcccgtttggcatatgaagaatttggcagtaaggcccatacttattctccggcgtatacggatactgattttccggttatcatgcaatgcagcagtcatataacctttaactccttcagtcagttccggcgtttttattctatggttaaggcctctggagaaaagatatcctgtggtatccgtattaatcctgaatattcggaagtagaggtggaactttataatccttgtgctcccggtacacgttttggggtgacggccgatttgcttcccgagactttaccggagggtatcgaaggcttccattgtcattgtcattgtgaatccagttcttatgaattggaacatactttgcagcacatagaagagacgtttgcccgttggttcccacaaataaaatggttgaatttgggaggggggcacctgatgacacgtaaagattatgatacggagcatcttatttctttattaaaaggattgaaagcccgttatcctcatttggagattattttagaaccgggttcggcttttacttggcagaccggacctttggtcgcttctgttgtcgatatagtggaaaaccgggggataaaaactgcgattctggatgttagttttacttgtcacatgcccgattgtcttgaaatgccctatcagccggcagtgcgtggtgccgaagctttacctgtcgatgcgataaaaacagctttaacggaagagaatatctaccgtttgggtggaaacagttgtttaagtggcgactatatgggtagctggcgttttgaccatccgttacaggtaggagaacgcattgttctggaagatatgattcattacactatggtaaaaacaaatatgtttaatggaatccatcacccttctatcgctatttggcatacagataatacattggaagtatataaagacttccggtatgaggactatcgtgatcgcatgtcctgatggtaattaaaaaaacttttggtttgtattgattatgaggaaattgatgaaataatgtaataaaagtgctataaaaagtatagaaaacttttggaagtttagaaaaaagcactacctttgcatccgcaatcgggaaacagctgagaaatagttaaagaccgaaggcggatatttgcggaaatagctcagttggtagagcataaccttgccaaggttagggtcgcgagttcgagtctcgttttccgctcacataaataaaatcttgtgggtgtgcaagagtattcacagaatgcccaggtggcggaatggtagacgcgcacgtttcaggtgcgtgtgtcgagaggcatgcaggttcgagtcctgttctgggcactatagcacgagattttcgtttctggaggaatggcggaattggtagacgcgccactttgagggggtggtgacaattatgtcgtgtgagttcgagtctcatttccttcacgaagagaggatatttgcggaaatagctcagttggtagagcataaccttgccaaggttagggtcgcgagttcgagtctcgttttccgctcacataaataaaattttgtggttgtgacaagagtgttacacagaatgcccaggtggcggaatggtagacgcgcacgtttcaggtgcgtgtgtcgagaggcatgcaggttcgagtcctgttctgggcactatgttagaggtttgcggaaatagctcagttggtagagcataaccttgccaaggttagggtcgcgagttcgagtctcgttttccgctcaaaagaaaagaccagtgtagaaatacattgatcttttttatttatcatggcgtgaatgtagaaaacggaagaaggtcaaatcaataaatattgatataccctcctcccgctgttttagtcaaatcatccgcaatggaaatatttattgaccaacgctaacattccttccggattatctttcaagtcgttacgtaaagtcagatcgttatagccagttaatttgctgatgattccatcaatcatagtagggctgaacacattatgtttttggaatatttcgcgctgttgctgcaaacaggctgcagaagccgtacagctatcgggaagctgggtcaatgccttcagtttgtctgcattttctttctgatgaatattgacgtttacgtaagttttttctgcaatgtctagtgcattttctatttcaaaaccatggcggcaggctacagctagtcctgctatcagttggtagagatcggccgatccgtccggtgatcgcatttccaccgtttgtttttgtgtggtatcataatggctttccgtttccagtggattggcagtcatgcacatatctgttttagttgcccatcctagaggtacgcgtaccaatactgaacggttgcggtcaccccagcaaatattagttggcgcttcctgatggggaaccaggcggaaataagaagtaggattggtgttaccgaatgcagtgatggatggagcaagttccatcatgccggcaatagctttgcgtgctgtttctgataaaacaccttctttcaacatttggttttgtccatctttcatgatacgcatgtggatatgcaatccggaaccagcttttcctgtagttattttaggcgcgaaagtaatgttataaccatgtttataggccagattacgtataatccatttggcaatcatcaattggtctgccgcatcttcggcattgacaggcaggaattctatttcattctgttcatatatcatgccattcaaggtaaaattacctacttcggagtgtccatactttatttgtccgcctgcttgtgcaatatagaccatgcactgggtacggaaatcattgaacttggcgtatggtgctgattcatgataacctttctggtctgttgcctcgaacatatttgtatccggagcaattacatagtactccaattctcccatagcctgaaattccatgccggttattttattgaatgccttgcatgctttgtgtaaggtatgttcgggtgaactttccaacggctttccatccttgttaaagaaagagcaaagcatggaaagtgtggggatctcggcaaaaggatctaaaaaagccgtccggaatcggggaattacatatagatcactgctgcccgcctcaatgaatggaaataggctggaaccgtccactcgctccccgcaagtcaggatagcatctagatatgcttggttgttgataacgaaattcaatgtcttcagtcgtccgtctccggcgggatacataaagttgaccatacggatgccattctgctgaatgtatcgttttatgtcttctttggtaaactctgcacaaggtttttctagaaatgccaccaattggttagggttcattattaattctttattcatagcaaaattggttgttttttgtttgttattgggttaactttccaaagataacaaaaagttttctgaaaatcctatgaaaagttcatagatattttctttcatactgagtgatattctctttatctttttctgtttgggagaacattgttttataatttgtcctacctttgcaccgctgttttaaaatataaataagagaatcattatggaaccgatgcataaaattaataaagtagaggtccggaatttacagatcgaagattacatccaattatcacaatcattcaaacgggtgtatgcggataaggatgtgttttggacacacgagcaaatagaaacgcttatccgaatttttccggaagggcaagtagtaacggtggtagacgataagatagtgggatgtgctctttctattattgtagactatgatatggtaaagggagatcatacctatgccaaagtaactggtaatgaaactttctgtacgcataatccggaagggaatattttgtatggtatcgaggtgtttatccatccggattatcgcggtttgcgtctggcacgccgtatgtatgagtaccggaaagaattatgcgagaaactgaatctgaaagcgatcatgttcggtggtcgtattcctaattattataagtatgcggatacgatgcgtcctaaggaatatttggataaggtgcgttcccgtgagatttatgatccagtattgacatttcagctttccaatgattttcatgtgcgtcgtgtcatgaagaattatcttcccaatgacgaagaatccaagcattgtgccactttgttgcaatgggataatatttattatcaggagcctacgcaggattatgtggataagaaaaccactgtacgtgtagggttagtgcaatggcagatgcgcccttataaaacattggatgatgtatttgagcaggttgagtttttcgtagatgccgtttccgattataagagtgattttgttctttttccggaatatttcaatgcgccgttgatggccaagttcaatcatttgggagaagcccagagcattcgtggtttggcacaatataccgaagaggttcgcgaccgttttatcaatttggctatcagttataatattaatatcattacgggtagtatgccatacgtaaaagaggacggagggctttataatgttggttttttagtacggcgtgacggttcatacgaaatgtatgaaaaggtacatgtcactcccgatgagataaagagttggggtctttcgggtggtaagatggtgcagacttttgatacggattgcgctaagattggtattttgatttgttatgatgtggaatttcccgaactttctcgtatcatggccgatcagggaatgcagattctgtttgttccattcctgactgatactcagaacggttattctcgtgtgcgtgtttgtgctcaggcacgggctatcgagaatgaatgttttgtcgttatagccggtagtgtgggtaatttgccgcgtgtacacaatatggatattcagtatgcacagtctggtgtatttactccgtgtgatttcgctttccctactgatggtaaacgggctgaggcgactccgaataccgaaatgattctggtttcggatgttgatctgaatctgttgaatgaattgcatacgtatggcagtgtgcgcaatttgcgtgaccgcaggcatgacctttatgaactgaaggtaaagaaataaaaaatgtttcattacggattacttaggttaacgctggtttatagataagtggttattattttatatttccactttacttttaagaataatctgtgttaatcagagtaatcctgtgatgagctctgttatttcggaataaaaggaactatgggccattcaataacaaacagagttcttccttgtccgctttcctgtaaatagagattgcccccatgtctttttataatctgccggcacagactaagcccgattcccgtcccttctgtttttgtagtaaagaaaggaacgaatattttttcttgtaactccatagggattccctgcccattgtcaagtagttttatataaagtttgtctgttacctccagtgttacttctatttgtccgtctgtctttccttccaatgattgcatactgttcttcagcagatttaagaaaacttgagagagttgcttctcatcgccctcaatatatatgtcagaaggggtactgcgcagaatgaaatggatatgggcattctcaaaatcagattgtagcaacagacccagattgtgcaatgaatcggtcagtgagaatcgcttctttttcggttccggcatatacgataagcgtcggtatgattctgtgaattccatcaatctttcgctctgttcacgaatcactccaagtcctcgtattactttctcgtccgtaccaggacgcaatgaaagtgtttgtgacagggaaacaataggagcgatggtattcattatttcatgagtaagcacccgggtcagtttgctccatgactcactttctttctcactcagttcattgctgatatctttgatagccaacagggtaatcgtttctgaatttagtttcatccggttcatggatagtgacagctgtttttttgagttggattgtaaaagaaaagaatcttccacatttctatgggctatgaaatctttcaaggccggatattgctcttccagttggcggaggaatatgattggctcaactcccagcaaacgtaaagctgcgccattcacaaatatgactctcttttcggagttccacgctagcactccattcggtacttcttccagtaaagagtaataaaagttctcctgtatccggctctgcgatttcgttgtggcaagcaattcattgatccggtttagtgaatggctcagtgcattcatttctttatctgccgattgctcgttgaacaatatcatgttctctttatcttccaccgcatccagaaatatccttattttggtattgaacttattcaaccgttttaccaaagctccgattaaaaaaagcgaaaagatgaatagcagactgccaagaatgagggcggtatgtgtaatgacaagtgcgatccctgctccggccacagcgattattaataagatgtagctcaggataaccatatatagatgtttgctgaataccatgattatcagagcttgaagcgttttatcttattgtaaagtgtctggcggctgatgcctaactgttcggctgttgccgtcagatttccatcgttttgacggatagctgttgctatggcctgacgttccacttcttccagattgggtacggtagtggagaattgagggttccaggtttgttttacgaaaatgtctttaggacggatgacatttccttcacataagatgatcgctttctcgatggcatgttgtaattcccggatatttcccggccaatgataagaacataatttctccaaagcatgttcatgcaaggaaatatcttttttttcgtatttggcggcataacgttgcataaaataatcaatgaataaatgtatatcgttccctcgttcccgcaaaggcggaatttccaggtggatggtattcagtctgtacaataagtcctcacggaaagtcccggaatccaccatctcctgaatattcttgttagtagctgaaagcagccggatatccactgggatgactttattactgccgatgcgtgtaatttttcggttttgtaatacggtgagcaactttgcctgcatggctagagggagatttcctatttcatccataaacagggaactgccggatgccgcttcaaactttcccggtcgactctcgtaggcatcggtaaaagaaccgcgttcatgcccgaacagctcactttcgaataaagattcactgattgctcccatatctaccgttaccatagtatgttcccgtcgtgtggaaagccggtgtatttcttgtgccagcatctcttttcccgttccgttttctccggtaatcaagatattggcgtctgtgcgtgccactttcactaccattttcattaactgctgcatggcaggagatgtccccacaatcattggtgattggcttctatcggggactctgtttttccttttcttaccacttccgaaagcttcttttattttgcataccaaggtccggttgtcccaaggcttcaacaagaaatcggtcgcatcattctttaaagctcttaccgccagttccacatccccgtatgccgtaagcatgactacgggtagtgcaggagctatctcgcggattcgtttcagccaatacaacccttcgttgccgttattgattcctgctgagaaattcatatcaagaataattacatctaccggagaggtattcagaatagatataatttgattcggatgatgggctgtctttatttcgctgaactctgtttccagcaacagttccagcgaggccaatactcctttattatcatctactattaaaattgttcctttttccatagcattttgctttcagaggctaaagatatctgcttttgactgttcctgcaaatgaggtgtccaattattggacattttttattattttctgtaatgcttttatttaccgtaggggcggtttgacacttggaatgcgtcttcagtccgttttatccgtgcttcaatatttctcttggatcgccctggctttgcggtgtttataatttggacgttataccgtctaaaaattggacgatcagtttatgacttcttttgtaactcgttgattattagtatgtcgtttgttttggcataccatttgatctctattctgtgtctaaaccaaagtaaaatgaaaaataatttgataattgtgtgtttgttgtcgagtttgtctttgcctgtgtgtgggcaaagtacactggacgattgcatacgctatgcctgggaacataatcccggtttcaagaatatccggatagacgtaaaggaagcacgtacagactatgtggctgccatgggtaaatttcttcctcatgtttcagtacaggcggaagtaggcaggcacatcgggcgttctgtcgatccggataccaatggatacactgccgattcgtataatcaagggactataggaatggatatcactctttctttatttgaagggtttgcccggattaatcgtttgcgatatacacattggactaaaaaagagaaggaatgggatcatttggcaaagcaaaatgatctggcttatcaggtagccgaagcctattataaagcggcattggataaaaagctttcagaattggccgctgagcagcttcgtttgggagaacgttatctgaagcagacggaaactttcgtagaactgggcttgaagtcgctttcggacttgcaggaggtgaaagcacgtcatcaaggagatgtgttcagaaagcgttcgtatgaaaaaaatagtcagatgtctttcctttatttgaaagaaatagtaggaatgaaagagggagatactttgtctgtttccttatcagctggtgaagatacacccttattaatgcctcaggtagaaatagaggaaatctatttacaatctgtacacgcgttgccggattataaacggatggagatgtgggaacgagcagcccgtaaggagtatgctgtggcccttgggcagttcagccccaccatcttcgcccgtttttcatggggatctgatttttataattccttgttctcgttacatcaattgcgtgaccattggaataaatatataggagtaggtatttcatttcctattcttagcggattggatcggtatgccggagtaaagaagaagaaattgaatttgcagcgagtgcggaacaatatagaggaagagaaactgcatttacgtaatgaaacggaacaaattgtactttcattacattcgggatgggaagaacatcgacaggctgtcctacaggtaaaagccgaaacacaagtgctgaaagaaacagaaaggaagtgggaggaagggcttgtttccgtattccaactgatggaggcgcgaaatcgcctgcttgccgctaaagcggaaaaaataagagtacgtttgcagtacgaactgacatcacgactggctatgtattatcaaacaggaagttttattaaccactaaaaatatggacacactaattgaacgtaaaaagcgtttcactcccaagcagatttatggaggtacgggagtattattcatactggtactcattctctattttatttttcgtgataccggttcttccatgaccattgacaaaagccgtatcactatcgctacagttacagaaaatgagtttaatgattatatccgcgtgattggccaagtacttcccagccgcatgatttaccttgatgctatagaaggcggaagggtggaggaacgccttcatgaggaaggagcaatggtaaagaaaggggatgcgattttgcgtctgagtaatccgctgctgaatattggtatcatgcaaagtgaagctgatttggcctatcaggaaaacgagttgcgtaatacccgtatcagtatggagcaggaacggttaagcctgaagcaggaccgtatcggtatgcagaaagactttcttataaagaaacgtcgttacgggcaatacaagcggctgatggaggagcaattgatagcgagggaggattatctccaggctacggaggagtatgaagcggcaaaagaacaattgtcggtattggatgaacggatccgtcaggatagtttgtttcgtttgactcagatatccagcttggacgagaatattatgaatatgaaacgaagtctggcattggtacgtgaacgtcttgaaaatctgaaagtgaaagctcccatagacggacaggtgggtaatcttgaagcacaaatcggacaatccatttctgccggagaacatatcggccagattattactgctgatctgaaggtacaggcattgattgacgagcattatgtggagcgtgtcgttcaggaacttcctgccgactttacccgtgacggcgagaattataaattagaagtaaccaaagtatatcctgaagtgaaggacgggcagtttcgtactgatttccgtttcacagcagggcgtcccggaaatatccgggccggacaaacttatcatatcaatcttcagttgggcgatcctgtcaaggctgttctgattcctcggggaggttttttccaaattaccggagggcgatggatatatgttgtggatgaaagtggtaaatttgccgtcagacgccctattaagattggcagacagaatcctcagttttatgaagtgactgacggtctggcttccggtgagaaagttattatttccggttacgaactgtttggagataatgagaaactgattttaaacgaataaaaaacacacgtaagaatgattaaagtagaaaacctctctatgttgttcagcaccgaggaagtgcagaccaaagcattgaatgaagtaactttcgagattggaaagggagaatttgtcgctatcatgggaccgtccggttgtggaaaatctaccttgttgaatatacttggaacattagatacccctacttcgggctcctatctctttgagggaaagcgagtggataaaatgaatgaaaaccaactgaccgctctacgtaaaggaagtatcggcttcattttccaaagctttaatttgattgatgaactgactgtctatgagaatattgaactcccattggtttatcttaatataaagccggcagaacgtaacaggcgtgtaaaggaagtgcttgaaaaagtgaatatgctgcaccgtgccaatcatctgccgcaacagttatcaggtggacaacagcaacgtgtggctattgcccgtgccgtagtaaccaatgcccgacttctgctggcggatgagccgacaggtaatttggattctaccaatggggtggaagtgatggaactgctcagtacactgaacaagcagggaaccaccatcatcattgttacccattcacagcgtgatgctgcttatgcacatcgtataatccgtttgctggatggtaagattattgccgagaatcgtaaccgccccatggaatctgataccaaaattgaaattttatgatcatacgaaattattggaatagcgcttggcgtaatctgatgaagaggaaaggtttcagcttcattaatatcttcggcttggccgtaggcatggcatcagccttattgatacttacttacgttgcttttgaatttagttttgacaagatgcatagtaagagtgcccggatttatcgtgtgcaaagtacttttcatgagggggaagctctgacggatgattgggcgactagttcatttggatatggttcggccatgcaggaaaatctggcgggaattgaggattatacccgtgtgggatgtattatccaaccggagcaattggtaaaatatggtgaattgtgtttgcgtgagaatgaaatagcttacgctgatcccggtttcttccgtctgtttgattttgaattgctgaaaggcgaccgcacctcttgtctttccatgccgggccaggttgtgatcacggaacggattgcccgtaaatatttcagagatgaagaccctgtcgggaagatacttatctttaacagtaatatgggaaaaatgtcttgtgaggtaaccggagtcatgaaagaaatgccttctaattcgcatatacattataattttcttttatcatatgccaccttacctaaatgggtacaggagtattggtacaaacatgaagcctatacatatgtattgctggattcgcccgagcgcaaagaagagatagaacgtgcttttcctcaattggccgagaagtataaaactgaagaggcattgaaaaacaagacttggggagtgaggttggagccattggagaagattcatcttaatcctcaattaggttatgaggccgagttgaaagggaaccgttcggccattatcgcattgattttcggagctattgctattttgattatcgcttggatcaattatataaacctgacagttgcccgttctatggagcgtgcaaaggaggtgggggtgcgcagggtagtgggagctttcccgaaacagcttgtcaatcaattccttttcgaggcatttgtaatgaatctgattgcctttgtcattgctctcgggctaatcgaattattacttcctgcattcaatcagttggtaggacgcaccatcactttctcggtatggttcaccgaatattggggcattttagtcttgctactttttgtagccggtatttatatctcgggttactatcccgcgcgtgcgttgttacgcaaaaagccgattgtattgttgaaaggtaagtttcagaacagtcgtgccggagagaatacacgtaaaatattggttattgtacaatatacagcctccatgatattgctttgtggtacactgattgtttttgcacaactcaattacatgcgtcgccagtctttggggataaagaccgatcagattttggtaatcaagtttcccgggcctaccgagggaatgaaaacaaagatggaagccatgcggaaagcgatcagaaagttgccgctggcttcaaaagtaacttgttccggagctgtaccaggtgaagaagtagccatgtttttatccaatcatcgtgcgcatgatgcattgaagcagaaccgattgtacgaaatgttaagttgcgaccctgactatatagatgcatacggactggaggtggtagccggacggggtttttccgaggaatatggggacgatgtgaataaattggttatcaacgaaacagccgcccgtatgttaggatatatggataatgatgatgccattggtgaggaaatagctgttgaaacggtaggagagcccatgcaggtaatcggagtagtgaaggactatcatcagcaagcgttgaataaaggttatacaggagtgatgctttttcataaagataagattgattggattcctcagcgttatatctcagtcgtgatgaaaccgggtgatccttcggaattagtatcacagataggagaaatatggaataattactttgcggattccagttttgattatttcttcctcgaccagttctatgaccggcagtaccgtcaggatgaggctttcggcgtattgatgggaggttttaccggattggctatttttatctcttgcttaggtttatgggtgttggttatgttttcttgtgccgtccgcaccaaggagatgggcattcggaaagtattgggggcatctcgttggaatttgttttatcagttgggtaaaggtttctttattcctattattattgcggttgtgattgctttgccggtagcttggttcagcatgaatgcatggttgagtcattatccgttccggacggaactggaggtgtggttcttcttgttgcctatcgtattgatgctgcttatttccttcttaactgtagcaggacagaccatgaaggttatttatagtaaaccggctcgttcgttaaaatacgaatgataagacataagatgcccatagtcagtaattaaggttgtaattcctgtaattcatttacaaagaatgtcattcccttattgtaaatttgcaaacgaagacaataagtatgataaaactttgaagatgaaaaacaatacaatgattattgcatgtttgtgtgctgtcggtataatgaatgttagcatgctccatgttcatgaaaatatgcagggtactactcgtacgagaagttataaggtagaagaagtggtggttacgggaacacggaatgaaacggacatacggcatttgccgatgactatttcggtggtagggaggcaaaatttggaacatacttatcaaccttccgtgcttcctgctttgaccgaacaggttcccgggctattcactacgggcaggggaatcatggaatcggattgtagcgacaggaacaagatgaatttgccggctatattgatgttcggtaggatatacaaggttggttgtctttaaatgtgggtatgcggattgactatcattcacatgtgggcactgagtgggttctccaaggtgggctggcttttcatcttcccggaaatgctgaaatgaaaatgatggtaagtaagggattccgtaaccccactatatgcgaaatgtatatgttttgcccagccaatccggaattgtttgtccggggggaaacttgttggcacaacactatgaaatcaacgagggttttcctatacctaagacgacattgatgagtggagtgaatttatttttagattatcttggtattgctcgtgatggatgtttttcagttctagccaataaataattgtttttttcatctaaactttgaataccttttgaatttttctataaaactaattttgcatctaaaattattttattaattttacagcgtttttaatgagagtctaactctctatagttacaaatgagcgatgagaaagggtgtcctgatggcatcctttctcttttatagtatatatctatattgtattggattttgcttatgttacgattatgtgaaatcacgatacgttttttgtatttccgtttctccaacttttagcagacttaattgttattcttgcattaaaaaacaattggatctccctttgttatatatttaacactcttttcatttctttttgttgaacaatctatgcgattcgcgtgttaatataatgtgtttttcatagtaatagatttaagattaatagttagtatttgcttgtgaaagtcagtacacttacggataaaagcgtttatccgaaaagaaaagagaggcaactggaaacggaagcctctttctttttgaggagtatcgtttattcattgtcgcttttgaataaaacattttttatttctgatataaaaaagatagcgtgagtaaatatcacgtcaagtataataaatgttataatcttaccgatacccaatcgataaatactaatttagctaatataatgcctgaaacggcttgtgaatggttacaatcattctaaataaagtaagataatatattgaaaaaaagagaagctgtctcaaacttgaatgcaagataagacagcctcttttttattgtttcatttcacgcaacgccttacataattgatccggacaggaagtagaacggtttccgcatcttacaccttccagtttctgtaagacctcttccactttcattcctttcaccaatcggctgataccttgtaagtttccattgcatccgccccaaaagaaaacttgttgaataacgtcatcttctacttccacttcgatgtggctgctgcaagtgccttgcgtcttataggttattttcattttattcttcctcttcagatgcaggtttcatgtttgtataaacggtctgaacatcatcaaattcttccagacgctctaccatcttgtctagagtttcacgttgttcaggagtcacatcttttaagtcattgggaatatatgtgaaatcaccacccacttcttcgaaaccacattcttccaagtgtttctgaattgctgcgtagctcttcggatcaccatagatggtgatagttccttcttcttcatcttcgtcgaactcatcctctacattatagtcaatcaaatccaggatcagttcttccatatccattccctctttcttcttgaaagtaaatacacatttatggtcgaacaagaaagctaaggaaccggtagtacccaagtttccaccgaatttgttgaatactgaacgcacatctgctacggtacgagtagtgttgtctgtcaatgtatcaacaaatacagctactccgtgaggaccatatccttcgtaagtcatacctttgtagtcactggtatctttacccattgcattcttaatggcgcgttcaatgttatccttcggcatgttttcacgcttacaagtagcgatcacaccacgtagggtcgggttattttcgggttccggaccacctgcttttacagctatagcgatttgtttacccagtcttgtaaatgttttggccatgtggccccatcttttcagctttgtagcttttctatattcaaatgctcttcccattggattgtagttttataatggttatttttattattatcttagttttgcacctagtttgttttccaggttagcaatcagtttggacatgatcttgtcaatctgtttgtcgttcagtgttgcgctttcatcctgtaacaagaagctcactgcataactttttttatccggttccagattcttgccttcataaacatcaaacaattctacttctttcagcagtttcttttcagtctcataggctattttttcgatttctgcaaactgtatgttcttgtcaatcaacaaagccaagtcacgtttcacagccgggaacttggaaagttctttaaagttgactttagccgacttgatggctttcatcagttctttccagttgatttctgcataatatacctcattgtctatatcgaatgctttttgaatcttcttgctgatgatgccgaaggtggccaataacttgccgccacgtgtgtgtacgctgatggctgttgaatagatatcgttggtcaggttaccgaataccacgttgccgaaattcaatcccaaacgggtaaagatgttcagcacgtatgcttttaattcgtaaacactgctgttttcatcgggatgggcccatgaattgctgacgcgtttgccggttacccacaatcctaaatgatattcttcagcataagccgcaagcactttttccgggtttttcttttctgcgttataaaaatagcagttaccgaattcaaagaatttcaaatcggcgttcttgcgattggcattgtgctggatgctttccaaaccaccgaataataaagtttgacgcatcacgttcaaatcgttactcaatgggttcatcaagtaaaccaaattttcgttcttgtatgtttccaatccttcgtaataggaagcggcggtcagtgaattgttcagtatttcattgaaaccacaacctaccagttgctctgaaatcagattttgtaatttctgggagtaatccacttcacctttggtggtcaggctggatttcaaggtagtaggaatctccacattattatatccgtagatacggagaatgtcttctactacatcgcaatcacgttgcacatccacacgataggggggaacttgtaaagtcaagcctccgggtgtttcgttcacaatcttcatttcaagactggtgacaatgctctttatggtttccaccggtatggtttttcctatcagtgagtggactttctcataattcagctctactgtaaaatcggctatcggggcagggtagttgtctttaatttcagaagaaatagtacctcctgccagttcttgaaccagtaaagccgcttctttcaatgcataaatagttccgttggggtcaataccacgttcaaaacggaaagaagagtccgtactcaatccatggcgacgggctgttttacgtacccaagtcgggttgaaataagcgctttccaaaaatacatctactgtctgctcggttgttcccgaatccagaccaccgaatacaccggcaatgcacatcggttcttctgtgttgcatatcatcaggtccttgtcggataatttgcgttccacttcgtccaaagtaacgaatgtagtaccttcggcaacagtcttcactacaatcttcccacctttaatcttatctgcatcaaaacagtgcaggggctggccgtatgcgtgaaggatgtagttggtgatatccacgatattattgataggacgtactccgatcaggcgtaatttgttttgcagccattcgggactctcttttacagttaccccttttatggaaactccggcataacgcggacatgcttccgtattctctacttcaatggcgatgtccatatcatggttatccactttaaacgcttctacagacggacgttttaaagtggcttgtttgccgttttgaatcaggtaggcatacagatctcgggccacgccgtaatgtgagcaggcgtccgcacggttcggggtgatatccacttccagtacgtattcgcttttgatattgaaataatctttagcgggagtacccggaacagcatccgccggcaatacgatgataccttcgtggctgtttccgataccgatttcgtcttcggcacagatcatacccatagattcaactccgcggagctttgatttcttgatggtaaaacattcttcgccatcgtatagtttggtgcccaatgtggcaaccaccactttctgtccggcagctacgttagcagctccacagacaatctgtaccggttctccttgtcccaaattcacagtagtaacatgcatgtggtctgaattgggatgaggttcgcaagtcagcacttcgccgatgacaataccttccagaccacctttaattgtttggacttcttctacgcctccggtttccaaaccgatggaagtcagcgcttcggccacttcatccggtgtcaaatcgaagttgacgtattctttcagccaattataagagatattcatatatgatattttttatgtatttcaaaatgacctgcaaatttagtaattattttcttttatcctgttatttatccatcacagattactcagattaacacagatttttctttgagggaaataatccgtgttaattctgtgagggataaataaatgtcagaacggtaaaggtccttcgggaataggggttccgaacggattattgtcggcaggtgcggcatcaggagatgggggaggtacattgttgccgccaccgttcattttggaacggataatacccggcgcctcacccggcataggcacgatgacatcatcgtccggattctggaagcgggcgaattcgccacggaaacgcagcagtacatcacctacggcaccgttacggtgtttggcgataatgatttctgccataccgtgcaggtcgttccctttttcatccgagtagattttatagtattccgggcggtggataaagcataccatatcggcatcctgctcaatagctccggattcacggaggtcactgagctggggacgttttccgtcaataccctcacgactttccacaccacggttcagctggctcagtgcgatgatggggatgttcagttctttggctaaccccttcagtgaacgtgaaatggtactgacctcttcctgacggctgccgaatgacattccgctggcattcattaactgaaggtagtcaatgataatgatttttactccatgctcgcgtacaagccgtcgtgctttggtgcgtaattcaaagacggacaaggatggtgtgtcatccacatacatcggagcatcgtataattcttttattttataatccaattgtccccattcatacggagccaactgaccactcttgattttctcacccggaatttcgcacacgttgacaatcatacggttgactaactgtacgttggacatttcaagagagaacaaagccacagggattttcgcatttaccgccatgttctttgccatggaaagcacaaaagccgttttacccatagcggggcgggcggcaataatcaccaggtcggaattttgccagcccgaggtcattttgtccaatgcatggaaaccgctttccagaccactcagcccgtccgttcgtgccgccgctttttgaagcatctcatacgcttcctgaatgacagggttgatttgcgtataatccttcttcatgttctgttgcgagatttcgaacagttttccttccgcttcctgcatcaggtcgtccacgtcttgggtttcgtcgaaagcctttgtctggatgttgctggtaaaggtaatcagttcgcgtgcaagaaacttctgcgcgatgatacgtgcgtgatattctatgtgtgcggaagaggctaccttgccgcttagctgtgttatgtaaaaaggaccgcctgcatcttccagttcaccggtgctgcgtaattgttcggccacagtcaagatatcgactggttgctggcgtaaagccaaagaggtaatagccgaataaataagttggtgacggcgttcataaaaagattcgggacgaagaatctcacttactaatgagtaagcatctttttctatcattaaggctcccaatacagcttcctccagctcaggtgcctggggctgtaaatgtccgtattcgtcaacaggctttgctttcgaagttttgggagtacgtgtcatttttctcgtttctgccattgtcgtctgtttaaagtagggcaaagatagaactttttgctgagttgggcactcgtccattcccaaaaataataaaagaaatatgaacctgaatctacggagaaatgaacaatctggacagtaaatggtttttttatatggtaaaatgaaaagtttgttctatatttggcgctctgtccggataaaagatggcgtgcatctttgtagaacgggcaacaatctaacgaaacacactaaaaataactatttaaagaacagaatatgattacatttcctaatgcaaagattaatttgggacttaatattgtagaaaagcgcccggatggataccacaatctggaaaccatattttatccgataaacctgcaagacgctctggaagtgacgcggcgggaaaacaatgacaaagaatacactttacacataagcggatctcctttggagggtgaacccgaagataatctggtagtaaaagcctacaagttattaaaaaaagactatcccggactgttgccggtagatatacacatgtacaagcatataccggcgggtgccggactaggtggcggatcatcagatgccgcttgtataataaagcttctgaatgataaattttcattgggactcagtacggaacggatggaggaatatgctgcaaaactaggggcagactgtgcttttttcattcggaacaaacctgttttcgctaccggaatagggaatctgttcgagcctgtggaattgtcattaaagggataccacataattttgattaaacctgatatctttgtgtccacccgggatgcgtttgccgaaataaagcctgtgcgtccggctgtttctttgaaagaagttgtaaagcaacctatagaaacatggaaaagcagtatgaagaatgattttgaagatagtgtcttcaaaaagttccctgagattgctgctataaaagatgaattgtatgatttgggggcagtgtatgctgccatgagtggctctgggtcttccgtctatggtattttcgaagcaccgatagagaatgtggaagataaattctgtggatgtttttgcaggcagagagcgttggaatagtgtggcagatcagtggttagtgattagtggactgcgctgtcatgccgcaggtattaaccactaatcactatagtctatcttttacatagtgccttgaaatcacaataggtacatttttctatgatttctgtttgggtaaatgatttttccggattaaatatttcttctaataatccttgaagtcgttcacggtattctttttcatatttactgaaatcttccacagcctctttgggctttcgtgactcgcccatttgtataacgggagaataggtttctgtagcggcccgatgaatatagagaagggccggagctatcttcatcgttggttgcttgcggcacatgatggcggcatacaggaacgtttggaatacatagttggaacgtttcttgtctggaataaacagagattccacatggggtggggtgtctgcatcaccacctgtcttgtagtccacaatacgaagtgtgccatccttgctgtccatacggtcaataattcctccgatacgtgattttatgactcctttgggtgtttgtatgtcgatgggttcatccacttccatttccgatgcaataaaagtgaagggagcgtaacgtaaatcattttgtaaaagttgttttaaatatcttgcaataacggcagagttgataagttgtacgccgttatattccggtttttcgttttgcggaacattaaagaataattttttgaatgctgtatccacataatcttgcagcttcacgtcattgcgtagcaacgtttccaatgcttccttattaatgactttgccatgagtggtcaggtctttataaatatgttcggctgcgtaatggaaaatacttccgaatgtggcggaatctatttctgcactcacttcatcgggggcggagaggccggctacatacctataataaaattttaaaggacaatccagataataattcaaggctgatggagaaaattttgctttgggattggcacggacatcaaacaggctttgcatctggcgcatgacatccggggtcttttctacagtgatagacgaggtgccttggggggactgtccggcctccagaaactgacgtgtgatggggtgaggccattcaataaggaattgcagcatgaaacggctccattcgccgcggttcagtccgtccgaactggtattgtaaattaaggtaatcctttctgcccgttgcagcagacgatagaaatagtatgcatatacggcaattttatgctctatagtagtcattccgaaagctttgcgcaggttgtaaggaataaaggaagagtctcctcccgatttgggaagctgcccttcattgaccgatagtaataccaagtggcggaaatccaggttacgtgtttccaatacccccatgacctgcataccaatggccggttcgccgtggaatggaatattagtcgttgataagatcttgaccagcaatcgccggaatgtttcgctttgtacggttaattcatcttcttctatcagtgtgcggaaccggttgatggtggtataggctttgaaaagcgattcccgataaagttggttgaatgcatctgtgtcctcggtaccggaagtgtttgcctggtaaatgcttgccacttgctgcaaagtttcggacaggcgtatgcacagattcaggtttccggaaagcggagtgaaaagccgggtcaggaattcatctttgcccaattcgccgggtaacggatagaaacggttgtttcgggtcagttctttctccaacaattcggcttgaccggtgagttggcgggtataggggtgttttaacagtgtaacaactgattgaaacgtgtagcggccgcttttgaaattaaatccgtgggtatgcaactccagtaaggcgatgaggaaactatatacaggagtttgcgataacggaaatcccatggtgatattgacatgttttacttctgccggcaatgaatggaggaccggttgaagcaatgcttcgttacacaatacgactgcggtttccttttccggtgtagtcagattgtttcgtatccattgaggcaggtaacgggcttgtgcattttcagtggaagatgcgatgtagtgtacctctttaggtttcgagagatttttgaataactcaccggacaaaggagaaggaaagtcgcgtaagttccggcggataaactctccggcttcatgggtgacggcttgtctgttttccttcatataaaattcgtcgtaatcccaataaaaaacagcttttccggcatctttcaattgggtgaacaacgtatgttccactttgttcagcacattaaatcctacaaaaacatatttctcgtatggaagtttgtccacatccagatgctctatgacgtgacggtacatcattccttcgtaggcaatgttttgagaagctaaggattcacggaaccctttgtagatgttccccaatacgttccataaagagataaaccgttctttcagcgctgttctccgttcgatggagaagttctggaagaactgccggatagcttcttcctgctcatcatcaatgaaggtgtagtcgtccattatgttgcgcagatcctgtaaattggaaaacagtttgtcggtatccactctatttttgtcggcatcgtcaaaatcactgatcagcatttctccccaaaaatagaaatcatccagtgtttccgtactttgagtttcccgtcggaatatcttataaagttcgcataccagttttaccggatcacccacttcccatggagaaagactacggaacaattcgctgatgctgacgtatgcgggcgaccaaataggtgagtccgactcttgggcgagatactcattaaagaaaagtccggcacgtttgttaggaaaaaccacggctgtatgtgccaggtttccttccgtatgtttatataaatcggctgctaccagtttcaaaaagctttccattattctatttcctccagttcgttgttaaatacataccataaatagccacggatatgctcatatcccatgtctgataataaatccatatattctttcacctgcttgttgtaagccttccgctttttaccgaatttaaagtccaccacaatcacctccccgtctttcatcatcacgcggtccggacggcgggtttgcaggactcctttttcccgataaataatggcacactcattgtatagttcccagcggcccgaataccattctttgaccagcggatgcctcaaagcccattcggtgagttttcgtatttgttcctcttgttgtgccgactctatgattccttcgaaacgcaggcgttctatggcgggaggcacatcgtccgtggtacggattacggagaatagattatgcaacaactgtccttgccggatgtatttgtcttccgtttcctcttctccccggataaattcggcagaacggttggactgtttgaattcgatgttggtttccagcgtttccagatggataggcaaacgtcgggctacagtcagcagcttgttgccggacacttgtttttcctcttcgtgagatgagagatagagcgttcccagttcgtatatttcttctccggtggcatagctctttccggtcatgtcggataaggcatttcctaacaattcggataccgttcctttctgttccgcctttccatatataatcaagttctttttggcacgggtaaatgccacataaagcaggttcagattatccacccataattgcaagcgttcattcaggaactcttcccgataaatggattgctgcatggctgtggaatagttgatgggaacaatgtcaagatcgctaaacggagcttgccggggagcacaccataccagatggttgtaagtctcattctccattttccagtcgcagaagggtagcagtacggtatggtattccaagcctttggacttgtggatggagagaatgcgaattccttccacctcgccggaagggatggtcttgctgcctagtttttcttcccagtaggtgataaaagcggataattcggaagaattgctttgcaaatattccgtcacggcatcaaagaaggcgcacagataggcatcctgttgtttgatgcaggacatctgaaacagattgaaaagtttttccatcagttcatacagtggcatgaggcgaagctgttccgcttcttttatgaaatcgaatggcagataatcatctatttcgttcagcaatagagtgttgagatctattcctttatgtaatacttcattctgataagcagcagccagttgcgctttggcaatccggtttccgggttgtgacaagtagcgcaggccatccattatcatacataccgccagtgaggcatccagtcggaatgcctcatcggatacgattttgtaagaggtgttcttgtcgaagtaatcggctattaaaggaatgcttctgttcttgcgcaccaggatggcaatatctttcagttgcacgccctgcgccacaagtagctccacttcttctcctaggtggtacagggtgttttccatataggtcatgtcttccgtatccgatagaaattccactttgacatacccttttccgggatctttgtatgtttcctgacacacgtcgttgtaggcttccttcagttccttgcattcctttttttgttcttccttataaatgttgttcaacacctcgcaggcggctgtaaacacttcgttgttgaagtgaatgatgtttgcagcgctccggcggttggtggtcagtgtctttactttgacgggaaaggcttcgatgtttgttttcagtccgttcagtatgccccagtcaccgtttctccagcggtagatggattgtttcacgtctcctacaatcaagctgtctgctccctgagacaaaccttcgagcagcaacagacggaaattgtcccattgcatacgcgaagtatcctgaaattcatcaatcattacgttgcgtatggttgttcctatcttttcgaatacaaacgaggaatctccttcttttaccaggttatgaagcaacgcgttggtatccgacagcaggaagcgattgttctcatggttcaattcgcgtacctcttcgtctatattggccagcagacggatattgtttacgtggcgcagggagagttggcaggaattggccagcatattgttccggcttctatatttttccgattcattcagcaggggaatcagttctttttctgccaggcctatgatagcgttgcgtatgggggaggtttttttcacccattcgtcggggcagtccagacatttttccactgttacattgcggacgctgtcatccagtttgcccgattgtagtttattaaaatagccggctatacctcgggaaccgtttttcaaatcttctactttcaccccgtttgtatccaatattccgaagaattggtcggcaaatcctttcatttgttcttgcacctcttccaaaatggcttgcagcgtcttgcggtaattcttgatacagtctttgtcccgtaatttttcccgtagcccatttcctttttctatatatccttcatcgaagatgtttcgtccgaaattctttatctcaccggaaacattccacctcttgtcatcggcaattctttcttctatgtattccaacagccaatagagtacgggagattgtcggtccagcttttctatcatggagtccacggcatcactcagtacctccatattgttcagttcgatattcagattggcacccaattccagctcccgtgccaaattgcgcatcaccgactggaagaatgagtcaatggtttccacccggaagcggctgtaatcgtgtatcatgtagtgcagtgccgtaccggcggctgtccttatgtcttctgggggcatttccagttcttctgtgattttctgtaaatagggatcagaatccttatcctttatccatattccgtatagctggctcagaatccgctctttcatttcggtagtggccttgttggtaaaagtcacagccagtatattacggtatgcccgtgggttctgtatcagcagctttatatattccacggccagtgtgaatgtttttcccgaaccggcagaggctttataaactaataattcaggagaatgtttcattttaaataatttgctaatttgctaatggctgcgctgtgtaccggatggtaattggctgacacattagcacatttttatttttaattaaaaaccagtacaaaaacagtggcctgtcccttttccttgtaaggcagcagggtcagtgtgccaccgctcagcctcatgatttgtttgcttagactcagtccgatgccgcttccttcctctttggtcgtgaagaaaggtacaaaaatttgtccggctgcatcgggaggaatagcgggaccgttgttggctatctctatacggatactttcttgcggatcacaataagctttcaaggtgatctttccgtcgggagcattacctatggcttgaatcgcatttttcagcagattcgtaaccacttgggctatcaggttctcgtcggcaaagactatcaggtcttcccgggcttcgaggatggaaagagtgatgttggggcatggatgctggtgctgtgccagtcggatcatccgttccaggaaaggacggacatagaacagcgatggttcaggtgatggcagtcgtgtcagtttgcgataagacatgacaaaatttatcaatcctttacctgtagagtgaatcgtttccagcccttgtttcatttcttcattttctgctccgggaagagccagtagtgtttcgctgagggaagtcaccggagtgagtgaattcattatttcatgagtcagtacgcgggtgaggcgtatccatgaatctatttcccgttcatccagctcccgattgatatcactcaaggcaataatgcggagttcctcgtctttgatacggatgccggacacccgtaaggcaagatgtactgttccccgttctgtgttgaactgaatttgcagcttgtcacccggaactgctttttccaaagcaatcatcagttcatccgagatgcgagagagttgtttgacatgagtcaaaacatccagccccaacagattcatggcctctttattcttttgataaacggagcctttgctgttcagcaccacaatgccggtttctacaaagtccatgatgagctcataatatttctctcgttgtgccgtttcctgttttacattgtacaaaatacgtgcgatgcggttcagcatgacattgaccatggaagaatcgccaggggaggcatgttcataaaaacgaacagcggggtcgtcgttttcgatggcgtcgagcagaaaggctatcttccgggtattaaaagtgtacaggcggtaaaaccagcctatggaaacaaggaatgaaggtacggctacgcatagccacagccaattgcgctgctggattagtaaggtgcaggcaatacctaggaacagtacagtgaaaaaacggaagaagaattgtttcacagcttgattatttattgtttcgttgatgcttctttagagtctgtttaaaatttgattgtagtgaggaaggacatgagaaaatggtcataatccgaattttttcatcttgttataaagcgtctgacgggtaattcccaactgtgccgctacagccgagaggtttccgttgcatttctctatcgccttctgaatcatttgcaattccatctcctccagagttgagacacttgtttctgtcgcaggagccgctacttttcggggaaaatgaaaatgttcctcactcaatataccatcttcattgataatgaccgctttctctacggcatgttccagttcgcgtatgtttccataccacggatatgtccgtaacttttcttgcgcaccggtagaaagaaggatatttcctttgtcatattgtttgcagaatcggtctataaagcgttcggccaaagggataatatcttctttgcgttcccgcagagggggaatctcgatgtggatggtattgatgcggtaaagcaaatcttcgcggaatttgcctttggccaccatctcttccaaatcacaattggtggcgcaaatcaaacgtatgttgacaggtatcggttcgttgcttcctactcgcaccacgctccggctctgaatggcggtgagtagtttggattgcaggtgatagggcaggttgcctatttcgtccagaaacaaagtcccttcatgggcggcttcaaatttaccagcacggtcggtatgggcatcggtaaacgagccttttttatgaccgaacagttcgctttcgaacagggattcggtgatggcacccatgtccactgttatcatatcccgccggtatcgggcagacaaagcgtgtatttcccgtgccagcatttcttttcctgtgccgttctctcctgtaatcagaatattggcatccgtttgcgccactttctctatcagcgtccgcagttgcttcatggcattgctttctccccaatacatagaagatacggttttagggatttccgctctcttcttgttcttggaggaattgcggcaggcagacagcaaggtttctatcagccgggcattgtcccaaggcttgacgatgaagtctgttgctccttccttgatgccgcgcactgccaggtctatgtcagcataggctgtgaaaagtactacgggcagggaggggtgtattttctttatctcatgtaaccagtacagaccttcattcccggtattcagtccgctgctgaaattcatatccagcagcaccacttgcgcatttccttcacgtaacgcagcgggcagtgtgatgggtgagggcagtgtgacgatatgttcgaaatgatttttcagcaatagctttactgccgacagcactcctttgttatcatctaccacaatgatggttccttgtttgctcataaatatcttctgttctttttcagaagaacaaagataatgattttctctcgtcaatcttttctttcagagaaaacttttcaatttcatgaattgttctattataaaatagcatttcaaatgaaaacatttatattaagcataattgtaaccatgatcacatcggtagctggtgcacagcaaaaaagtttttatgactttacggtcaagactattgacgggaaggacttgccactttccacattcaagggtaagaaagtattggtagtcaatgtggcatctaaatgcggtttcactccccagtacgccaagttggaggagttgtatgagaaatatggaaaagatgattttgtcgttatcggatttcctgccaataatttcctgcatcaggaacccggaacgaatgaagaaatcaaggagttttgtacgttgaattatggagtgacttttcctatgatggctaaaatatctgtaaagggaaaagatatagctcccctctatcaatggcttacgcataaaagtgaaaacggggtttcggatgctaagatagggtggaactttcataagtttctgattgatgaaaatggtagatgggttgcctcaatcggctctactactagtccgctttcacaagaaattgtagaatggattgaagaataaaatgaccagaagataaataatgccatattgttattgcaccagctttccgtttttcagttccgacatcagttggcatttaaagaaacatcactaaaaatagcggaatatattttcgtcctatttattaaattgctatctttgccacgttttccacgccggtacttccgcaaggaagttagggaggtgggaaatatacatatatagaaaagacgtttacttgacgttttgttcttggctctacagaacttcgcaaattctaaaatccagccaaaacaaagcaacagtaggtgtctgcggggtatgtttatatccttggtgcgcctttgtcggtcaaaggtgcattcaagtgtcattatacatatcggcgtgggcttctgcgttgctcgttcagactggattgggcaatgcgaaggccttgtagggcgggacgagtaacaggtacagattcccgctttttttatatataggtattacaattctgatttaacacataagaaccgtccggttcgggaatctgcggaaggtcatcggttgacccgacaggctgcatctacatcgtgcggattcccatcctccatttgttgaaatagcttttctttggtcagcttaatcacaagaggccgattcctcttgtattttacgaaacttctcgtaattgattgaattgcagatatatatctgtacttcaaagttccataactatgctttcaagtgaaaaaatgcaatggtttgccatgcgtgccacttatcgccgggggatgcagatcaaggctttgttggataaagaaggaatcaacaatttcattcccatgcgttacgaagttcgtataaggaacgggcgcaagaggcgtgagctggttcccgttatcagtgatctgatatttgttcattccgtccagtccgaacttcagaaggtgaagttcaaacttccgtattttcaatatatgattgatatccgcaacgggcagaaaatcattgtgcccgatgatcagatgaggcagtttatcgctgtggctggaacgtatgacgagcatcttatcttcttcagtcccgatgaggtgaacctgcgtaaaggtacgaaagtccgtattacgggtggtgacttcgagggctacgagggggtgtttgtaaaggtgaaaggtgcgagagaccgtcgtgtggttatcagtctgcaaggggtgatagccatggccatggcgacgctttcgccggacttgatagaagtgatagaagagccgaagaagagatgacttcatttgctacgttaaacattcttattccttgattaatggggaagtaaatgatctgataatataaatcttatgtataataatgtgtagaaccacatccatgccgtcaggcatccggctccagcagctgattcagaatcggtataaggaaattttagccagggaaaagaataatgataaattcattcatctgtatgacattgacgcgtattgggtggctttcgagcgttccgcctgtaggttgagcggtttgttttctaaaagtgagctgactttgtttcgtgtcccggattgtgtggaatatgtggtgatggtttctgttcctgccgatgaggcggagggctgtttgggtgagtacatcattttgcacgatggaatttaccggaaagtgtggtcggagcatgttttgccgatgggggattatcgtcattggcatgagatggctgtgaggtctgttttgttgtaaagaaaagtatgtggacttcgtgagccaagtaagtggtgttactttgtctgcggacatatattactttgctcacgaaaatatcttacttttttcagtggaatatggttattgatcatgctctatagggaataccctgaaaaatccttcaaaagcttcagcctgctcgcaaacgccctacccgtgggcattccggctgaaggattgggttcaggaatccttcagctgggggtggaatgtttcagccgaactgatcttcctccgattcttagggaatcgtttttcctgaaggatattttccggctgaaacatttcacaatgcatatccttcagccggaatgccgacaggcagggtgtttgcggagtggctgaaagatctgaaggaaaagtaaggcgtttcggcatgtagataccgttatggaaaaaacaacaggtcaaatttttaaaagctcttgttctttcaatgaaaacgtcctgttcttttttttaaagaccttgttcttttcggaaaagaacaggatcttttaagggttagtaacgtgtatgccggaaggttagtaacatgtggggtgacacgttactaatgtgtgggctgtaagcttagtaatgttgcaggtggaagatatatatctttcaagtgatttgaatatattaatagaattaggatacatattacgggacttgtctattatagacataatattttaatgtgcttttttataattgaaaatgtctgctttatctcagcaaaataataaaagaatagctaaaaatactctattactttattttcgtatgctttttatgatggctgtaaatctttataccagccgtgtgattttggttacgctcggtgtggaggattatggtatttataatgttgtgggtggggcagtaactatgtttagttttataaacagtgcaatgacgggaagcacccaacgttttataacttttgctttaggtagaggagaagaaaaagaattatcaaaagtgtttagtatgagtgttataatacatggcattatttcgttggttataattcttttagcagaaacaataggtctttggttcttttatcataaaatgattattccaatagaacggatggatgccgcattttgggtttttcaatttgctgttttgacagcggttgtaatgattatgagtgtaccttataatgcagtgattatagctcacgaaaaaatgggcgcttttgcatatatttctgttttggaagttattttgaaacttattatcgtatatgtacttgttgtgttccattatgataaattgaaattatatgtagtactcacttttattattcaaatatttgtttgcctggtgtatagtacatattgtaagaaacattttcgagagtctcattttgtatggacaagagataaaaagctgttttctagaatgctattatttgctggttggacaatgaatggcaatttagctgttatgggctatactcaaggcttgaatcttcttttgaatatgttttttaatccggtagtgaatgctgcgagaggtcttgcagtgcaagttcaattagctgtatcaaatttttgtcgcaattttcaaatggctttgaatcctcaaataacaaaatcttatgcaataggggattatagttatatgcatgaattggtctttgcgagttcacgttattcgttttatttactctttttgctgtcctttcctgtttttttagagagtagatttatactatctatatggcttggagttgtacctgattatacaattccttttgttcggataatgttaattatcactttgtgtaatgcattgtctaatcctatgattgtttcagttcatgcaacaggtaaaataaagaggtttcaaatgttagagggaggggtgttgctgttgatatttcctgttgcatatttatgtttgaaattaggaatgctgcctagaacagtgtttattgtacatttattgatagaaataatagctcaatttgtgagagtgtgggtagtatgtccaatgataaagatgaataaacatgactacttgataaatgtaataaagccgatattaaaggtctctttttgttcttctttagttcctattggactttatttatatcttccctctcatttatacagtgctgtgtttataattttgtcttgtccattgtgtacattaattatggtatatctgaatttatctgttgtggaaaagagaatattgaaaagaaaatatatgttgtggattaaaagcaaaagattatcaaatattagattttaggaagagagaatttaaaaatatccaattgacaaatattaggtgcttaagttagaatagtgtaattatatattaaatgtctagtaatgaaatcaagcgaagttataatttcagtaattgtacctgtctataatgcggaaaagtacttaaagcgttgtgtggatagtatactttctcaatcattttctgattttgagttattgctgattgatgatggaagttctgatttgtcagggctattttgtgatgaatatgcaatagctgacaagcgtgtcagtgcttttcatacagataataatggagttagtggggctagacaatatggtcttaatattgcaaaaggaaaatatattcagtttatagacagcgatgattggatagaacaggattgttttgaaaaactttttttaatagctgaggataaaaatgctgatattgtaatttctgatttttatgttaattcaaagaataatgtaaaaatcgttaggcagcgatatacaggaaatcttattgaagatttgtttacaggtcgtgtctttggtggattatgtcataagttagtaaaaaaagcagctattgataatgcaagtattgcttttaatcatcaattaaatttttgtgaggatttgtgctttctatgtgaactggtaatgaaaatatcaaatgtaaaaattatttatataggggaatctttttatcattattgcattaacagtatttccttgacacattcaaagtcattgaaaaaagtataaaatgaagaacattatattaatgtaatacaaaatattattcctaagcagcctgctagttggttgcagtgtaataaaatctctgtaaaatggggatatttgcgatatggaaaattatcttatcgcaaatatttagaactttatccggaattggtcttacgtcaaaagaaacttaaatatttgataattaatatatgtaaaaatagaatatgctattacataataaatacaatatttagaattatacattggtgatatggtacaagtttcaatattagtacctgtatataaatgcgagaattttgtatacaaatgtgcagattcgttattcagtcaaacttttgaggacgtagaatttatattttatgatgattgttcacccgataggagtgtacaggtgatagaatcctgtttgaaaaaatatcctaatagaagagatcaggttagaattatttctgggaagtacaatgttggtgttgcggcagctcgcaaccttttattggcagaggcgaatggtgaatatatttggtatatagacagtgatgattggatagaaccagattcaatcacattgctatatcatacagctatcacttctaatgcggatgcgatttctttcggattttattgtgaaagtatatcacgctatactgtacgttatttcacatataaatcaagagaagaatgtctgcaagatgtgataggcagtaattggggagttatttggcgcttctttttcagaagattgatagcaataaataatgaaatcgtttttcctttaggatataaaggaggtgaggactatgtattctgtgttaagtatctgttttatgcaacaagcatagtttgtgttgatactgctttgtatcattatgttgtttataatacaatgtcacttattgcaacaaaagatattcagagtttagttcatcaatatgatgcaactctagcagttgaatcttttttgaatgagaataatgttttacgattgtattctaaggacttagatttgagaaaatcttatgtagtagtttctttcaataattattttattcatatttggggccagctatatctagcttcatggaaacgaatggctggaagatacaaacagaaaataaaaaatatttttggttgtataattagatggatatgatgagttatagtaaaaagtattctagattattgctttggggtatattttcttttttggttttgacaggaaatcttttgtctgtcataggctattctagtctgataaacataagccctgtatttaaattgggaattggtgtaatattgttgtttttctgtttctttatatatgttcataaaatgacaatacccaatccagagaaacatatattcattgtaatagcaataatgttatatgtaaatatgatcatcaagggagaatatcaaattactaattatatttcagctattgtatttccggtatgtttatcttgtcttttctctttgtttcagaataaacgtatgcagatggaagttcgatatattgtgatgatattcttctatttagaatgttttattgctattgtggaaaaaattatgatgtttcattttttcggcaatatggaaaatgaagatgcttttgttggtagaatagattcctatgagtttaggagttgtgggttatggggacatcctttgtctaattcttgtatattgtctttaatgatgccatttattcttttacaaaatgagttctcaataaagaaaaaaaatttgttatggagtataggtatgttggctctgttatgttttaattcacgtttctctattgtcctgtcagccgttgtatatattttgttgaattataaaaatatgatatactctcgtcatcggataaaatatgtattgtgtataggattgacaagcgctgtctttctttatatgctattcaatacaagttttggagggcgtttgcttgatttaggattatatggagatgccagttcaatggcaagaacagaaatcttagatatttttcaggttgtggattatagggaatttatgtttgtcggaattccttatgaggatattatatatattcaagcgatggctggtttggattatcttattattgagaatccgtggattatttttatttttcgatatggtattctgcaaacatttgctatgattcttttttttatccctttgtttcataagtggttaataccttatgggaaatttaatgcttgggttatttgtattttgttcttatcgcttgtttcctcttcaaattctttggctgtaggaagtactgctattgcacaagtatacctttttgcttttgcgtttaaaaatcaaaaaaataaatatgattccaaagacaatacattattgttggctgagtgatgaacctattcctgccaatattcaaaagtatatagatggatggagaaaagtgatgccagagtacagaataaaaaaatgggataaaaaggcttttgatattcatagtgtaaaatgggtagaagatgcttatgcacaaaagaaatgggcgttttgtgccgattatatccgagcttatgcattatttactgaagggggattctatcttgattccgatgtgattgtaaataaaaaatttgatacatttttgaattatggttttgtatcttctatggagtataatcacacttacaaaaaagaattaaaggacagtataaccttagactacaaacgcagagaaagtgtaagaaaagttgttggccttggtattcaggctgctattataggtagtgaaaaagggcatccttttacaaaggaattattggattattatcatactcatcagtttgtaaatgagcaaggagagtttgatcaaacacctgctccagttatctattcctggctcatggaaaaacgaggactaaaatatagggataagaagcagatgttgaaagataaagtgtgtctttttgattcgggagtatttgccagttatcctactgctagatttgggagtgttgctattcacatgatggctggttcatgggtggatgtaaagcttgatgatacctttatgcgcaggttgaagaaaatgttgatagtccgtaaaatatacaatttattgcatatatcataagatctaagataaaaatagtatcagctttcttttgagaaaatgtagattatgactagacatagtatatttcaaaaattgattcgtttaatagggcgaaaaaacacagcgaggctgcaaatggctgtaaagtatgtggtgacttttagaaaagtgtatacggctgattctaagacgcatggtaatgagtcgtttatctctcctcctcgtgtggtttttattattgatggaaagacacctcatggtggtttgagcgaccgtttaagaggcttgttttctatatattattattgcaaacaaagaggatatacttttaaagtagcttggaattatccgttcaagttagaagattatctgatgcctgtacatgaaaattgggtagctgacgaagccgatttgacacatgacaagaaggttgttgattttcgtttctttaataattatgtagggatgagtgggcatcaagctgattatttcagtctgctggatttcaagaagcccatttgtcatgtatatagttctattactcaacgtgaggatttatatccagctttttttcaagaactatttaagcctgctccccgtttggagcaggctatcagtcaatgtttgcaggaaataggtggtaaatacatcactgtgtcattccgtttcatcggtattttgggggattttaaagatcatgcagggtttggggaagagttaacagtggaagaaaaaagatattatatcaaaaaaagcctagcgtgtttggaacaactacatatgcgtcatcctcaatgttataaaatagtagtaacaacagattctccgtatttcttgaagcttgtgaagtccttgtcgtatgtttatgttattccaggcagattagagcatatggactatgccgtggttgatgattatgaagtgcatttaaagacttttcttgattttatgataataacaaaagcagagaaatcatattcttatcaatatggaaagatgtatggcgccacaaaatttgctttaacagctgcgctaataggaaataatgagtatgaagtcgtaaaagattaatgtttaaaagataatttttgtgtttgaatataattataaataaaattaactagatgaatatagcattattaatagcaggcggttcaggaaatcgtatgggacaagatatccctaaacaatttatgcatgtcgatggagttcctattatcattcggacaatgcaatgttttcaacaacatcctgatgtttctgcaatagcagtggtgtgcttgaacggttgggaaactgttttacaatcgtacgctaatcaatttatgattgataaattaaagtggatatttcctggtggaaacacaggtatggaaagtattcataatggagtttacggattgaaagaaatgggatgtaatgatgaggatcttgttcttattcatgatggtgtacgcccactgcttagtcaagagataatttcctcaaatatcgcaatttgcaaagcttatggctatgctattacaggtattcaatgccgagaagctatattggaaagcggagatggatttacttctacaacaagtattccgcgtgatactcttattcgcactcagactccgcaaacttttcgattgaagaatataattagggcacatgaatcagcttataaaaaaggtattgtaaattctgtagcttcttgcactttgttggcggaacttgatgagaatattgaaatgcatattgtgcctggttctgagaagaatataaagattacgacagtagaagacttggaaatcttaaaggctttgatgcatacagataaggataaatggttgaaatagaaataatatggcataccaagatgatataaagaaagctgccgctcttttgttgccgtggaataagttgagtggctgtaatattttagtaaccggagcaacaggcttgattgggggatgtcttgtggatgtattgatggctcataaaggcagaaattataatgtatatgcatctggaagaaatgaggaaagagcaggaaggcgttttctgaaatatgctgatgacaacgccttccattttgtgaaatacgatgtggcgcagcctttggaatatgatgtaaattttcagtatattattcatgctgctagtggagcatatccggaggaatttattaaacatcctgtagaagtcataaaaggtaatattaacgggctggataatttgatgggttatggcatacaacatggtataaaacgtttgctctacatttcttcgggagaagtatatggtgaaggcgatggaagagtatttacagagaattatagcggatatgttgattgtacttcacttcgttcatgctatccttcaagtaaaagagcggcagaaacattgtgtatatcttatggcgcagaatatggcatagatgttgtaatagcacgtccttgtcatgtttacggaccaggatttacagaatccgataaccgtgtgtacgctcaatttattcgtaatgtgcttcgaaaggaaaatattgtgatgaaaagtacaggagaacaatatcggtcatggtgttatgttgtagattgcgtatctgctttactttatattttattaaaaggtgagactcagcaagcatataatatagcggatgccagttccaatatttctattagagaattggccgaattaattgctcagttgggtggagaaaaggtgattacaattctgccggaagatatggaaaagaaatcttttaatgttgtaacaaaatctgtcttttctacaaagaaactggaggcgttgggttggcaattgaagggttgtatgaaagataaaatgttagcaacaatcaaagaagcaggcaatctatgatttctaatccaaaattgaaaaagatttttcagacctatgtatttggggtggtttctataatcaataagcgaatcagacatgacaaacgaaaaataatattgtattctaacatgggatttcgtgataatgtcaagtcgctttatgactatttgatagagcaaaaatataatgaacaatatgaaataatttgttgctgtaatgattttaagcggtggtcttttgttaatatccccaatgtgaaatttgttagttgcgtgaagggatttttttattatttctttgcaggatatgtgttttatagctttgggaagatacctatagtgccaggaatcaaccaaaagactattcaactatggcatggaagcccttataaggcggctgatgcaggtatgttgaaggggcattcttggaaacatcaatattattctttttctgtagctacttcaagaacctttgccaagatatggagcagatatttctctatgccattggatcatgtgctaataggaggacaacctcgcaatgacattttatataaatcatggcccgaatatgattttggggattataaaaagttggtattatgggcacctacttttagatattctagcaaaatgggctatcaagatgtagaagacgctaagatagttccgatattgcatagtgaagattttattaagattaatgattatttgaaagaaaagggagtaaagatagttgtaaagttacatccagttcaagacttagataaatatgatatgatggaaatgagtaatttcatactgcttagtcatgcagaatttgtaaaacgtggtatggatctttataaatttatgactcaatgtgatgcattgatcacagattattcatccatattttatgattatttacttttagaccgtcccattgcatttacagaagatgacttggaggattattcagatgtgcgtgggtttgctgttgatgatccgcaaggttacaagcctggatataggattcggaatttgaagaatctttatgagtttatagattgccttttgacgaatacagacttttataaagaagagagaaagcgggtgaatgaattggtgaatgaataccgtgacggaaatttctgccaacatatattagatttggtaggcataataaaataaaaaatgaagaatattcttgttgtgattactacagcttttgttcctacaggggggctgactacagtgatgatgaactattaccgcatgatgaataaagaggaggtgaagatagactttgcttccactaataatccgccacaagttctgcttgatgaaatacatgccagtggtagtgaatattgtcagttgcctgatcgcaaaaatgttttggcatatttttttgcattgaagaaattatgccgaggctatgacgggatgcatgtgcatgccaatagtgctatggcagtgatggaattacaggcggcaatatgggcaggaataaaaatacggattatacataatcatagtagtagatctcaacataatcttttaaatcagttgtttttgtctctctatagacgttcttttactcaagctgttgcttgctctgatgaagctggagaatggctttatggcaagaatgggtttattacattgcgtaatgctataaatgcgaagcgttttaaatttgatgtagtgaaaagattaataatgcgccataactttggttttggtgatgatgaatatgtgataggacatattggtaaattcatggaagcaaaaaatcatccttttctcattgaagtgtttaccaaatatcatgccttgcagccaaagtcaaaattattgctgattggtgatggtgaactgcgccatcttgtagaagcagcaatagataaaaataaagtcaatgattgtgtaatattggcgggattgcgttctgatatcccagatgtgttacaggcaatagatatttttctttttccttctatttatgaaggtatgccattatctgtggtagaagcacaggcatcaggcctaccatgcattatttcggatgctgtaactaaaatggtaaacataggtgaagatgtaattcaattacctttaagtaaaggtgctgactattgggcggaatatctcggtaatgttaaatacgaattgtctcgtcaagaacgttgcgaaagaaatactgaacttatcactaaagcgggttataatatagaaacggaggcggaaaacctcatgagaatttacaaaaacttgtagtataaaatatgacatctctcttagtcaatcacatcttgcaaacagagaaatggacgtctcccgaacttttcgaaacgaaaaacagaatttacacctttctcaaccccgtatcttacctcatagctttagaaaacaaatctctatttaaacaattcgatggtatttttgccgatggctctttactggtttctgccataagattagtatacggaaagcgagtgaccagacgtagttttgatatgacctcccttgctcccgaattgttgaattacctcatggaaagccgtaaaacgctctatatcgtagcctcgggtcaagaacaagtggagtgttctgtgaggatatttcaagagcagtatccgaagttacgcattgcagggttcaggaacggatatttctcttcggatgctgaaatgaataaggaagcttctcatatagtcgaattaaatccggattttctgatagtaggtatgggggccttgatgcaggaaaagtttctgcttaaggtaaaaaagatgggttaccaaggcatcggctttacgtgtggtggctttgttcaccaaacggcaatgaataggatgcactattatccggactgggttgataagatgaatttgcgtttcgtttatagaatgtataaggagaaacatacacgtacaagatatctgcaagctgcattcttgtttccggtacgctttatcggggaaagaattttcggatgaaagagcagactttgcttattgccatgtaaataatggagaatggcaacaacaggacgaagatagcagtaggaataatttttccgagtatttttaatacatctgttttcatgctgcaaatataaattaaaattcatagaatagtgaaattaagaactctaatatttctggggggactctttggaggaatgaatgttatcaaagggcaggctttttatggtactacaggactacttcatgcacctactgccgttatgcagaaagataaaaccgttatgctgggaggaaatatgctggatgtaaatatactttcccgatattgggtgagaagtgaatatcatccctatacctataactattatataaattgtactctgtttccttggctggaagtagcatatacttgtacgttggtaaaggggatacatggttcttcttattggcctcagcaaacttggggcaggtttaccaatcaggacagatcgtttcatttccggttgagggcatggaaagaaggctggtggaaggcttggacgcctcaggtagtgattggtgcgaatgatccgggaagccattcttcaaatggaggtggagacatagattgggggggcggtggtagcggaaaccacaattacttgacacgttattatctggcggcaacgaaacatgttgaatttagtggaataggtacagtgggggggcatgtagcttgggttatcggtaaagctatgagtgatgtgcattatagccgtcctgctgcaggggtaaattttcactttggcatgaagggcgaaggtttctggcagaaagctctgaatggatttaatctgatggcggaagtgtgtcccggacatgcggaagatctgcatacagcaacttatactgtgaatgtgggtggaacttattcaatatggaaagaccatatcaatcttattgctgaactgaatgacggtaaattttttagcggaggtatattctttaaattacatctcaaataactgacttgatttctagtggatgaagcattataagaatagccggaatcacttggaaaaagtagttccggctattcttatataacgatatttgtatgtcctgtttttattatcctacaatgtatttagcattcttgccgcttattttacgaatgaataccacaagcagccacgatacgccaaatgccacgattgcggcagcgggaatttgtaaaggcacgggaacaccgatattgcgcatcaggactacacccggacctgtgaaaaaataatgtatcatatagatgccaaaaccacatacggtcaagtttgccagcatacgctggatcagttctgagcgtacttttactttcttggctatgaggaagaaagggatagtcatcataatcacattcaaagaattataggtgaagaacagttctaacatttcatcagtgcattgtggtaatgcggtcatgtggcggaaaccgaagaatgtgaccatgtaacctgccagaaacatggggatacagaccgacagtgtcttactccatgaccagtcgtggttgcgcagatagtgtcccaatagcaagtacccgttgaatccggcaaaataatagagcatattgaatgagttccacgcacagcctccccaaatgtatggggatacgaactgataataataaggtaacaaaccagttattccccatgcgacaagaaaccatagtttggctttctccgagaccttttctacccatgcggagaaaataggaaggtatagatataatccgataagcagatagatataccacatatgtacgtctaataaagagaaattgagaggcatttttgctatataacccaatgatacgttgagtgactgacgggcggcttcttcaccgctataagggaaaaagtcaagaattatttcgggattaagtcccagcaatcctgtaaaccaaggaaataaattataaatgacactccagataaggaacggccaaaatacacggctgattctttttttgtagaaggcggatatttcgccacgtacgggaagcagcaatgctcctgtaatcatgacaaacagtgggacacacggacggagaaaggctccgtaggcggctccccagaatttgatttcatcaatgttggctggcggttcgccggggtaaaagttgaacgggtctgcactatggcagcaaactacggtgaacatggctaccaaacgaacgacatccagccataccacatgttttcttgtggtgttcatagcaataggttgattcataatttaatttttgatttgacaggcacaaaggtacactttctctgaggattatttcttgctttggaacaaaaaataaaaagaactatccgcaatcatactacaaaatgagaatcctcccactgcaagaatcacaatcatttgtctttcgcagggggaggaattctattttgggttagagggttattttagtcctctgttcttcaacaagggatcaataccgggttctttgccgcggaaattgacatacatgtccatcgcatcgtcaatgcagccgggagtgaggatatatttgcggaacttaccggccacttcctgattgaaaatatcgcccgtttccttgtatgcctcgtatgcgtcacaatccagcacttccgcccaaatataactatagtaaccggcagtatatccaccacccatggtatggttgaaataagtggtgcggtagcgtgacggaatttgtttcagcaatccgcgcttacctaatgtttctgtttcgaactgcataacgtccatatcatcgggaatttcttttaatacatgataatccatatccagcagggaagcagctaaatattcagccgtagcgaagccttgtccgtatttgccactcttgtccattttttcaaccagtccggcaggaataacttcacctgtctgataatgtttggcatatacattcaatacctccggttcaaaagcccaatgctcatctatctgtgacggcagttctacaaaatcacgcggaacactagccacaccataataatgtacatctttgaaaagattatgtaaagcatgtccgaattcgtggaacaaggtattcgcttcgtctgcactgagcaaagcgggttgtccggctgccggtttggtaaagttgcataccacggttactacaggagccactttcttgccgtccttgtaggtctgtgaacgatagcttccgcaccatgcgccacctttcttgctggcacgcggaaagaagtccatatagagtacacctagatgagaaccgtctttgtccttacattcgaatgcctgtgcatcgggatgagggaggggaagattgtccagctgggtgaaagtgataccgtacagtttgttggcaacatagaacacaccgttacgtacgttttccagtttcagataaggacgtacctgattttcatccaagtcgaatttggctttcttggcccggtctgcataataacgccagtcccaaccttcggctgtgaaggtttttccgtctttctttatttcggcattgatatctgccagttcttctttggctttggacagagtaggtgtccaaatctggtctaataatttatatacggcatccggtgttttcgccatacgttcttccagtgcaaaggaagcatagttttcatatcccatcagcttggctttttccagacgggctttgagcagtttgcgtaccacttccttgttgtcgtattcatttccgttatttcctctgttaatgtatcctttgaatatcttttcgcgcaggtctcggttgtcggcatattgcaggaaaggcatgacgctgggattatgcagggtgaaaatccatttgccttccatgcctgcttctttagctgtttcggcagcactggcaatcaggttttggggtaatccggctaagtcttcttctttgtccacgatcaattggaaagcattggtttccttctgcatattttggccgaaggtgagctgcaacatggaaatctcactatttaattcacgcaattttttttgactttcggcatccaggttggcacctccacgtacaaaatctttataggtttcttccaacaacttcttttgctctttgtccaaattgccgggattttcatagacagctttgatacgtgcaaaaagtttttcatttaaggcgatgtcatcgctgtgttttgattgtagtggagagagttcacggctcagtgcatccatttcatcattggtattggcgcttttcagtccgtagaatacggtgctgactttacgaagtaacgttccgctttgatccagtgctgcaatggtattctggaaagtggcgggttcggggttgtttactatagcgtcaatctctttctgttgttcttccatgccctgcaaaaaggcgggtttgtaatgttccatcttgatttggtcgaaaggaggaacctggaagggagttgtgtactccgaaaggaatggatttccggtaggggctgcctgtttcccttgcgaaccgcaaccgcttaatatggcaaccgcacaggctgccaaaagaatgtgtttcataataatttgttttatataggtgataatgcaaagatagtaaaataaggcaaattccaataagtttgaagcgtagaactatttgtttgtttttatagtttgtctaattatcatacatcattgtctaataattagacagactgtttctttttgttcttttgcaatatgttgttaatcagttgtttgtttgcgtggcacggttttagcatttctattatagagaacgaattatagaaactttagtttcttatacactttatgggaagtaacgttgtgaaacgggacttctctctttcaaaataataatgattaaaaacacgaaatatgaaacagatttattatgtcattcaggctttgatacatggacgaagttctaatataataaaagtcgtctcgttaggcttgggcctgactatgagtattctgcttttctcaagagttgtgtatgagcagagttttgatacttgttttaaggatcatgataaattataccaattgtggaatatatggacagtaaatggggaacctcttcctcctagtgaatatattatcggtgcagctgccggaggcatactggatgcaatgccggaaattgtggaatcggcggcaagtgcggggatatggccggtatcatcacctgtttacaacggaagtgtccgttttgatgattttaaagttgctgctgattcattgttttttcagacaatgggtattgaggtcttgagtggtgatccggtacgcgaattgcagcaaaaagatgtaattttcctgagtaaagatttggcggataaaatgtttggcggtgagaacccgattggtaaaataattagtttcaataaagaaattgagttgacagtcaaaggaacgtatgctgctttacctgagaattgtactatgcgaccgaaggccgtcatttccttgccttctatctggagccgccggataggaaattattcatggaacggtggggacagctggaaagaatatatccggttgaagcaggatattgatttggatgaattgaacaagcgtattgatatggtagtacagcaacatattcccagaagtgataagtttggaatcactgtcatggcaaaacctgttcgagatacgtaccgtggatatgatgaagtgaaaagaatgcgtaatattatgcttattttaggtatatctattttgtttatcacgacattgaattatgtgttgatttctatttcttcattgagccggcgtgccaaaagtattggtgttcataaatgcagcggagcggggacgggtactgtttttggtatgtttatgtgggaaacaggtattattattttgctttcattgtttttgatggtttttttaatgtttaatttccgggagtttgtggaagatactacagctgctaaactggagtccctttttgcggtggaacgtatttgggtgcctttgggagtgactgctgtcttattcctcattggtggtgtgctgccgggacgaattttttcaaagataccggtcacacaggttttccggcgttatacagagggtaaaaaaggatggaaacgtccgttattgtttatccaatttgcaggagtggcttttatatgtggattgatgtgtgtagtgatgctccagtatcattatgttattaataaagatccgggttataatcctgagcgggtagtgattggtattaataatgcaccggatgctgaagctcggcttgctgcccgtcacttttatgaagggcttccatacgtggaagcattgacctcagcaactagctatccgtctaatggatatagcgggcagatgataccggatgagaaaggaacgagccttttttccagtcgctatgattttactcaggagaattatgtcgcttttatgggaatggccatacagcaagggcgtgtaccgcgtgaatccggtgaggtggctgtcaatgaggaatttgtgcggagaatgcattggggaaaagatgttttaggtaagagtattcagacagaagaaggacgtgtcaaaatagtaggtgtgattaaagattttaatattgacggattctactcagagctgaaaccatttgttttgcaccatcatcccagagatttggctgatcttgtttatctccgtctgaaggaaccctttggtgagaatcttcagaaactgaaccgtgatgctgccgaagcttttccgaatcaaacagtcggttttgaaagcttggaacaaaaaatggcggatagttataattccgttcgtgtatttcgtaatgcgactttattggcggcaattgccatcttgtttattactttgatgggactgataggctatattaatgatgaattacagcgacgttcgaaagaaattgctattcgtaaagtgaatggagctgagtcatttgcgatattggaaatgttggtgcaagatgttctttggatttctttcccggctgtagtcgcaggtacattaggagcatggtatgtaggtggtttatggatggaacagtttgctgtgactgtaggttcgcttgttccttattatgtatgtgtagctattgtggtcttgatattgattgtcagttgtgtcatttccaaaacatggcgcattgccaatgagaatccagtaaagagtattaaatcagaataaggatcaatagaacaaacaattaaaatttattattatgatacagattgaaaatttaagtaaggtatttcgtacttcagaagtagaaacaattgcgttgaatcatgtaaacatagaggtgaaagaaggagagtttgtagctattatgggaccatcaggttgtggaaaatccacgttgttgaacattcttggattattggataatccttcggagggtagttataaactgataggaaaagaggtggccaatctaaaagagaaggaacgtacccgtttgcgcaagggtgtgataggtttcgtgttccagagttttaatctgatagacgaactgaatgtttttgaaaatgtggagttaccgttgacttatcttggaatcaaggccagtgagcgtaaggagcgtgttctggaaattttaaagcgaatgaatttgagtcatcgtgccaagcattttccgcaacagctttccggtggtcaacaacagcgtgtggctattgcccgtgctgtggttactaatcctaaattgatcctcgccgatgagcctactggtaatttggactcaaagaacggtgctgaagtaatgaatctattgaccgaacttaacaaggaggggactagtattgttatggtaactcactctcagcatgatgccggatttgctcatcgtgtcattcatttgtttgatggtagcgtagtggcgaacattaaagaataattaatgaaaggagggttgttatgaaacaaatctattatgcaatacaatcgatattacacggccgtggaagcaacgtgacgaaagtcatatcgctttcattaggtctgactattggtattctgcttttttcacaaatagcatttgaactcaattatgagaaatgttaccctgaggccgaccgattggtattggtacgtggagggggagagaatgtgaagactggagagaaaggagaaggatatgatgatagcttgtttgctccgatggcagaagcgttccgcagtgatttgtcacaatggattgaaaatgctacagtcattttcaattttgagacattaaatgtattcaaggatggtcataagctgaaagatgtaaattacgcttatgtagatacttgctatttccgtactttcggcatcaaagtattgaaaggaaatcctgaggaattacaaagggcggggagtatatttgtttctgaaacttttgttcgtgatgcttttggtgggcaggaccctgtgggacaaaaattgtccttggataaacagcatgaactgacagtccgtggtgtttatcaggatactccggaaaatactgcctatcattttgattttgtagctcccatttatgccggaggtggctatatagggggtggaacatggggacgtaatgacatttattatactattctccgtttgcgcgatggggtggacagagaagaaatcaatcgtcagatatacaaggctatgcaaaaatattatcctgattctgctgatgatgaatggagaagcttttatgatgcacagccattgcccgaaattcatctggatgactcaaatacccgcactcgcctttacatttatggttttttgggctttgctatattttttgtggcgatcatgaactatgtattagtagctattgctaccatgagccgcagagcaaaaagcataggtgtgcataagtgtagtggtgccagtgcaatcaacattttcagtatgttcctttttgagacagggattgtggtattaatttccgttatagtggccctctttattattttcaataccaaagatctgatagaagatttactttcggtgcagttatcttcactctttacattggaaactctatgggttccgatgctcattgtttttgtactgttcatggtagccggagtgttaccgggaagattgttttcacgcattcctgtcactcaagtttttcgtcgttacacagatgggaaaaaagggtggaagcgttctcttttatttgtacaatttatgggagtatcttttgtaatggggattttgttagtatctttgatgcagtatcatcatttgattaatagtgatatgggtatccgtactccaggattggtggaggcggagacatggatgtcacccgaagaagctgagaatatggttagcgatcttcgtcgtcaacccatggtggaaaatgccacccgttctatgcatggggttctgggagagtattggactcgtgggctgattgataatagtggcaagagaatagaaaccttgatgtataatccttgtgataaaaattatgctgaaaccatggggattactattattgaagggaaagatatgcagaatgagggggatgtattggtcaacgaagaagtagtgcggctgatgaaatggacagatggggcagtaggcaaacgattgaatgattttgataaagctggcaccattgttggtgtattccgtaatgtgcgcaatacgtcttttctctataagcagtttcccgtagctttagtttatagtcataatactagccacacttttgatgtacgtttaaggcagccatacgatgagagtttgaaaaaactgaacgaatacatggagcaggtgcattccactaaggcattggaatttattccgatagataccatgctgaaggaaatctatcgtaatgtataccgttttcgtaattctgtatggattacttctacttttattttgcttattgttgttatggggttgataggttacgtgaatgatgaaacacaacgtcgcagtaaggaaatagctatccgtaaggtgaatggtgctgaagcttcgactattcttcggttgctgtcccgtgatatattatatgttgctgtcccatcggtcttgataggaattgtagtatcgtactttacaggaaaggcttggttggatcaatttgccgaaacgatagatatgaatgcgttgtattttgtcggaacagcattggtgattatcgctctgatagtggtgtgtgtcgttgttagagcttggcgtattgctaatgagaatccggtaaagagtattaaagttgagtaactaaatagatagcgatgaagcaattatattatgcaatacaaacgatattacacggtcgtggaagtaatgtgacgaaagtcatatcgctttcattggggctgactgttggcatcctgttgttctcgcagattgcatttgagttaagttatgaaaaatgttatcctgaagctggaaatctaggaatagtccgcgcatattaccataatttggaaacaggtgagtcgatgggggacgatggggatatctatgattattccgtttttgctccgatagcggcggctttggctgagaatatgccaggagaagtggaaaaagctacttgtataaattcttacacagccaacggtaattattattatgaaaatcaattgttgtcggatgacgaacagtgtcttatggtggatacttgttttttccaaacctttggcattccggttttaaagggaaatcctaacgatttgattaactccaatactttgtttgtgtccgagagttttgcacgccgtttttttggtgatgcagatcctataggtaaagtgttaatgttggagcggaaaactgaaatgattgtccgtggtgtttatcgtgatattccggagaataccatgtttaaggcagactttgtagtaagtgtacataaagaaggaggttataaggatggagccggatggggaggaaatgatattttttatgcagtgttccggaccggagaagcttcggatatagaggtggtaaacgataacatccagcggatggtggagaaatacatgccgactgaacataacggttggaaactggaactcagtgtcattccattggcaacaaagcatcagacttcttcagaaacaacaaagcgtctagttatctatggctttttgggtttctctatcttctttgtcgctattatgaactatatgcttattgtaattgctactttgggacgtcgtgccaagagtgtcggtgtccataagtgcaatggtgccaataatgggaatatcttcagtatgtttatgatggaaacgggcattattgttctggtatccattctggtctgtgcatttatcattttcaatgcgcgggatttgatagaagatttgctgtcggtgcgacttgcatcactctttacatggggaactttgtgggtaccgctgctggttgttgtacttttatttttgttggcaggtgtattgcccggacgtattttttcacatattcctgtcacacaggtattccgtcgttatactgatggtaaaaaaggatggaaacggtcactgttgtttatacagtttactggtgtgtcttttgtcttgggattattactggttacgttaatgcagtatagtcatttgatgaacagggatatggggatcaatactgccggactggtagaagccgaaagttggctagacattgaaattgttcctcatatgcgcgatgagatccggcgtcagcctatggtagagagcgtggctacagccagccatagtgtattgggccaatattggacaaaaggattgatgggcagtgacggcaagcgtataggtgttcttaatatgaactatgtggattttaattatccggatgtggtaggcattacgattatagaaggaaagccgatgacccatgccaaagatctgctggtgaatgaagagatagtccggcttaagaaatggacggatggagccgtaggaaaaccttttgatgagattaaggaaggaactatagtaggtgtgttccgtgatgtgcgcaatcaaagtttctatcaggcgcagcaacccattgtgctgataggtggtaatgcgtttaatcataccttcaatgtacggttgaaagaaccctacgatgaaaatttgaagcgcctgaatgaattcatggacaaaacttttccacaagtggctttaacattccatacagtggatgatatgctgtccgaaatctataaagatgtatatcgtttccgcaattctgtccttatcacttccggttttatcctgcttatagtgattatggggctgataggttatgtaaacgatgaaacgcaacgtcgcagtaaggagatagctattcgtaaagtgaatggtgcggaagcatcaaacattctccgtctgctggtatgtgatattctatatgtttctattccttctattttactcggaattgttatagcttattttattgggaaagcatggttggaacagtttgcggaacaggttgatcttaatccgttactctttttggctacggctttaattgtagcgattattattgtggcttgtgtggtgcttaaggcatggcatatcgctaatgagaatccggtaaatagcattaagagtgagtagtgtattgggaaaaaggagagcgggatgatatgtgttgggtatcatctcgctttttttctttttacctgattcctgtgaaatttacattgacaccatccaatgtgccttttaagaagtttccggccaaccatacattttcaaaatatgaaatgtcactgggaccgtaaaccatacggatgcatgtctgtgcgctgttatcccatctccattcaaaattgtacctgtcttcggttacatagccgttccgatgttctattcgtatgatgtctgtgcctgttctattttcgtaaaagtctagtcgttgtgtgtagtattcaccgtcttgttcccaagtttcctgccaggtccggctgcatagttcccgagtggttctgtaatatatttcgctgtaatcatcatcatcgtaccaactttctatggatacttcacaggaggttaggttaaccattattatcagtacaactaccattccgaagtatttcagtatttttgttctcatatccgttaattttaaaatttgtttttcttatgtcacaaagataagtggagagaatgatacaataaacggaatattcctatttgtaaaggagaatttccctatttgtaataggaaaattcctatagtgaggagaggggaataagggtctgtcttatttcttttactattaaactgtaggttacaaaaagaggctgtccattggtgagacagccccgataatttccgaaaaatgataacaggatatttctatatattttttgattatccttgtttgggtattatctacgttttttcaacgaaaaaagtggtgcttcctgtacttgcttcattactctcaagagattacctccccaaatctttcttaaatcttcttccgtatatcctttttcaatcatttttatggtcagattaattaagtcattatctcctttacatccttgcagaccaccaccgccatcaaagtccgtacctattcctacatggtctatgccggctactttaatcatgtggtctaaatgttcgactgcatcacaaacggatgcggcttttggggttttattgatataggtatcgaggagacataactgtgccactccgccatttttcgctagtgcacggagttgttcgtctgttagattacggtcatggtcgcataaagtccttgacgaggaatgagaggcgatgataggttgtgtactatattttataacatcccagaaagtaccttcactggcatgtgatatatctatcataatacctaaccggttcatttccttcactacctcacgaccaaactgtgtcagtccttgagtagcatcttccgtatgagtggacgaatggcaaatatcgttatcgtaagaatggcagagagttatataattgactcccatctgtttgtatttttttatattcttgaggtccttgccgatggcgtaaccattctcgatccctataaagaaagctttcttgccttcattctttaaacgtaccaaatccttttccgtaagggcgatgccacaaaaatctttgtatttcgctacttcgtcataaatggattgaatcaacagggtggtgctttctacggctttttgtgaagatacgtcatctcgttttccctgccatataaatgcggctaggaactgtgcatccaatttaccttcctccattttttggatgctgaccatgttgtcttttctcaagcctacgctgtaaccgtttttaaaccaaagaggagtatctgtatgagtgtcaatggatagaatacggctatgaatttttttagctagatggaatgtatcagccttgttcactaggaatttaaataatttatgcatggtggtatctccggctgttgtaaatatttctggatgaaattgtacacctatcatttgtcgtatgggataagcttctatagcttccgctatactgtcgggcgcccaagccgtgattttgaatcccggtgctaatttccggatagcctgatgatggaatgtattgacttgcagcacttcttgtcctgtaatttctgctaacttgctttcctttatgatggatatcggatgggtgggggtagtgccggattcttcttggcgatggttgacacttgaggaatgttgtgtgggcagatcctgatataaagttccaccgaaagctacattcattaattgcagtcccctgcaaattcctaatatgggaatattccggtctgcggccatttttagcaccattaagtcgaaggtatcccgggcggggcttacttcttccagtttttcataaggaaggtcaccataatatatcggttggatatcttctccacctgtaaagacaattccgtccagctgggatacaatttgacgcagtatctctacattatccgttacaggtatcatataaggaattcctccagagagaatgactgactgtacatatgccgtgtttacggctgtccgtttcggacttatatctgtagaaattccaatcaggggagacctttttattccgggaatcagttcggaatccactttttgattcaattggacgagtgcttcgggcaaaggattcttttgacttttttgtgcttgtacatggcaacatcccaaagctaatagtaatacaaagaggcatttgtttttcatatgagtatagattttgtcttgtagacaaatgtataaactatgtttttcttaaaaaaataaaatgccataaaaatagagtaggaggtacttgttctaagtatctcctacttttatattcagaaaataatcaatttatttcatatcttccacagccgcctgagccgcagcaagtctggcgataggtacgcggaatggagaacaagatacataattcaaaccaactttgtgacagaatttcactgatgaaggttcaccaccatgttcaccgcagataccgcatttcaaatcaggacgaactgaacgacctttatctacagccatttcaatcagctgacctacaccattttgatcgagtacttggaacgggtctactttcagaatcttcttttccagatataccggcaagaatgaagcgatatcgtcacgggaataaccgaaggtcatctgagtcaagtcattggtaccgaatgagaagtattctgcacggctggcaatgcggttggctgtcaatgcagcacgcggaatttcaatcatggtacctaccttgaacggaatttccataccttctttttcaaataatgctgctgctgcatcacggattaccttttcctgagcttcgaattcatacaggataccggtcaagggaaccataatttcgggatgcggatcatatccttctttcttcagttcaattgcagcacctagaatcgcttgagtctgcatctctgtgatttcgggataggtgttacccaaacgacagccgcggtggcctaacatcggattgtgttcacacagactttccacacgttttttgatttcctgtacagttacgcccattgctttagccatttcttcctgaccttttgcatcgtggggaacgaactcatgcaaaggaggatcgagcagacgaacattaaccggacatccatccatagccttaaagatgcctttgaagtcggctttctgataaggaagcaatttggctagagcttttctgcgtccttctacatccggtgataggatcatttcacgcatagcgacaatcttttcagcatcaaagaacatgtgttctgtacggcaaagaccgatacctgaagcaccaaaggcgcgagctacttccgcatcatgcggagtatcagcgttggtgcggacattcagcttggtgtatttgttgcaaagatccatcaatgcggcgaaatcgcctgaaacttcggctgctttggtttccactttacctttatatacttcaccggtagtaccgttcagagagatgaaatcaccttcttttaatgtaataccttcaatttctacggtacgtgtcttataatccacattgatagcaccagcaccggatacgcagcatttacccataccacgggccacaactgcagcgtgagaagtcatgccgccacgtgcggtcaggatgccttcggcgacagccatacctgccaagtcttccggagaagtctctatacgtaccattactactttcttaccatcggcggcccatttagctgcatcatcggcgaagaacacaatctgaccggtagcagcacccggagaagcgggcaaaccacgagtcaaaacttttgcttctttcaaagctttcttatcgaacacagggtggagaagttcgtctaatttattaggttcgcaacgctccaacgctgttttttcatcaatcattccctgacgcaacaagtccatggcgatttttaccatagctgctccggtacgtttaccgttgcgagtctgcaaaaaccataatttcccttcctgtacagtaaattccatatcctgcatatcgcgatagtggttttccaatttggtctgcagggcatccagttctttgtagatttccggcatggcttcttccatagagggatatttggctatgcgttcttcttcagaaataccggcacgttctgcccaacgctgagaaccgatttttgtgatttgttgcggggtacggataccggctacaacatcttcaccttgtgcgttgatcaaatattcgccattaaacaaatcctcaccgttaccagcgtcacgagagaagcaaacaccggtagctgaagtgtcacccatgttaccgaataccatggcttgtacacttacagcagtaccccattcggcaggaataccttccatcttgcggtaaagaatggcgcgttcgttcatccaactacggaatacagcacagatggcaccccaaagttgctcgtatgcacaggtcggaaaatcttgtccggtttgttcttttacagcgactttaaagcgtttaaccagttctttaaggtcttccacttctaattcgttgtctagcttcacacctttttcttcctttactttttcgatgatttcctcgaaagggtcgatgtcttccttatttaccggcttcatacccaatactacgtcaccatacatttgtacgaaacgacggtaagaatcccatgcgaaacgaggacgtccggtcttgcggctcaagccttccaccacttcgtcatttaaacctaaattaaggattgtatccatcattccaggcatggaagcacgagcacctgaacgtacggaaaccaataacggattttctatatcaccgaatttagagttcatcagactttcaatgttggcgatggctttctcaacatccgctttcagcagttctactactttatctctacctaactcataatattcgctacaaacttctgtggtgattgtaaatcccggaggtacgggaacaccgattagattcatttcagccaggttagcgccttttccaccaagcagatttctcatatctgcttttccttcagcttgtccattaccaaaggtgtaaactctttttttatccataataatgtatttaaagttaactcgctcaaaaaatgtaatcgcaaaactatacatattttatttatctccaaactatttactgaaaaaaattagcagaaattgtaatttctactttacaattttaatatctttcgatttatgggggtatattcggggaaaatgcttaaatttgtccccaaattaacttattcggaaaagtggctagaaagaagaaagaacttccattattagagaaggtaacgataacagatgtagctgccgaaggaaaagctttggcgaaagtgaatgacttggtagtgtttgtgccttatgtagtacccggtgatgtggtagacttgcaggtaaaacgtaagaaaaatcattatgcagaagctgtggcagtgaaattccatgagtattctcctgtgcgtgcagtacccttctgtcagcattatggtgtatgtggtggttgtaagtggcagtgtctgccatacacagaacaaataaagtataagcaaaagcaggtgacggataacctgacccgtatcggcaagattgaattgccggaaatttcacctatcatggggtcggaaaaaacggaattttatcgcaacaaattggaatttacgttttctaacaaacgttggctgacagaggaagaggtaaaggaagatgtgaagtacgatcagatgaatgccgtaggtttccacattcccggtgcatttgacaaggtgctggctatagacaagtgctggttacaggatgatatcagcaaccagatacgcaatgcgattcgtgactatgcatacgaacacaattattctttctttaatctgcgttctcaagaaggaatgcttcgcaacttgatgattcgtacctcaagtacgggtgagcttatggtgttgctgcaatgcaagattgtagaagagggtgaattggatttaatgaagcggttactgacttttgttgcagaacattttccgcaaatcacttccttgttatatgtagtcaataataagtgtaatgataccattaacgatctggatgtgatggtgtttaaagggaatgaccatatttttgaggaaatggaaggcttgcgattcaagataggagcgaaatcattttatcaaactaattccggacaggcgtataatctttataaggtggcccgtaattttgccagattgactggtaatgagttggtgtatgatctttatacggggactggaaccatagccaacttcgtttcacgtcaggcaaagaaagtgattggtatcgaatatgtgcctgaagcgatagaagatgccaaagtgaattcggcaatcaatggcattgacaataccttattttatgccggtgacatgaaggatatcctgactcaagagttcatcagtcaacatggtcgtcctgatgttatcatcactgatcctccccgtgccggaatgcacgatgatgtgattaatacaatcctttttgctgagcctcagcggattgtgtatgttagctgtaatccagccactcaggcacgtgatttgtctttgttagatgccaaatacaaggtgatggccgtgcaacccgtagatatgttcccccatacacatcatgtggaaaatgtagtgttgctggaaaaaagaggataatccgaatggctcaattataaattgtttaaacagtaaatagaattatgtcaagaggtaaaaaaaatgattccggcagaccaaaggcgaaaagcgttgcccgatatactatatataatgtgacggagtccgctgagctgatggatttcctgatgcggaaaatggcgggaatcagtcgtagcaaggtaaaggcgttgcttgccaaccgtgtgattttggtagataatgtgattactactcaatataacttcgcgttgaaaccaggtatgaaagtgcagatgtctaaggcgaagaataaccgtgagtttaaacatccgatgctgaaactggtatacgaggatgcttatatcttggtggtggaaaagaaggaagggttgctttctgtcagcacagaacgtcagaaggaacgtactgcacaacatattttgaatgagtatgtaaagcgctcacatcgtttcaaccgcgtatttgtagtacatcgtctggaccgtgaaacttcgggattgatgatgtatgccaaggatgaaaaaacccagaatactttacgtgataattggcatgatattgtgacggaccgtcgttatgtgtccatcgtttctggtgatatggagaaggattacggtacagtagagtcttggttgaccgaccggaaattgtatgttagttccagtcctgtggatgatggggaaggtaagtttgcggttactcattataaaacaataaagcgagccaatggatattctttggtggagttggatttggaaacaggacgtaagaatcagattcgtgtgcatatgtcggatttaggtcatcctgttattggtgaccggcgttatggcagtgagtgtgatcctttaggacgattggcgttacatgccttcaagttatgcttctatcatccggtaaccagagagttgatggagtttgaaactccttatcctacggcatttaaaggattaatgcagaaaaaataggaagcttcgtctgttaaaattaaataaaagacgtcttcgcttttattttgagcagagattgagaataaaagtaagacaatatccatccgtctacattttggtaggtggatggatattgttgttttggatataataagatactatcatactgggataaaaaaaatgataccgacttatcacaagccggtatcacgaaaaaataatcactttattattttgtaatcatccagctttgtgcgctcacaaagcacggggaataaaaagttatttatatactaacactgtaaacaactactttcacaagctattgtttacttacctaataaaaggtagcttaacaaatatcacttaatgttcattttttttgtttgaccttacaaaggtaacacaaaaattgagaattatactatatagttctaataacggataatattgcggtaatttaggcgctatttaagccatttatctaaccagttaaagaatgtgcgttgccataacactccattttgcggtttcaagacccaatgattctcatccggatataataaaagttcggccggaacaccgcgcaacacagccgcattgaatgccgacataccttgtgaagcgagaattctataatctttttcaccatgaatgcagagaataggagtgtcccatttgtcaacgaagcgatggggagagttggcaaaggtacgttgggctgttgcattgtttttgtcccaatatgcaccacccatatcccagttggcgaaccacatttcttctgtctccagatattgctgttccatattgaatataccatcgtgtgcaataaatgctttaaaacgtttgttatggtgtcccgccagccaatagacggagaatccgccgaagctggcacctacgcatcctaaacggtcggtatctacatatggttctttcgaaatatcatctatggcggataaatagtctttcatacattgacctccgtagtcaccgctaatttgttccaaccattccatgccgaatccgggcagaccgcgacgattcggagcgatgataatataatcgttggctgccataatctggaagttccagcgatagctccagaattggctaacgggactttgtggcccaccttcacagaataacaaagtaggatacttcttgtttgcgtcaaaattagtgggatagatcacccatgagagcatttgcttgccgtcagtagtcttggtccatctttcctctactttgcccaatttcagttgtttaaagatgtggtcattctcgtgtgagagttgtgccacttgtccgtcggcaggagtgagagtgtagatttcatcagcagcactgatagaatgacgtttggtaattattttgtcgcctgccatggctactgatccgtagtcatacatgccgtcagtcagtttttttatatcaccattcagattggtactgtataccatgctggttccatgccatacaccgataaaatacagactttgtgaatcattgttccagcagtagtcatctacgcccgattcgaaactttcggtgacaaatgtcttttggccgttattcaaattgtagacgcacaggcggtttcggtcgctttcgtaaccatcgcgctccatgctttgccatgcaatgtatttgccatcgggactgaatttcggattagtgtcatatcctctcatctcatctgttccattcgaatcttgtccattcagtttgcacaggttcagtgttgtgcctttttctatattatataggtatatatctgagtcggtagatactgcgtatgccaatccttgcttctttcggctggtgtaagctatttgtttagagtcgttgctccaagccagttgctcgatacctccgaaaggtttcattggagcttcaaacggttcaccttccatgatatcggtggctgctcccatcatgttaccattaaaatcagcgataaaaggatgcggaatactttctacccattcgtcccaatgtttatacatcaggtcgtttacaatgataccactggctttgggtaggtcagggtagaggtctacggtgcgttggccgtattttatttgtgagatgaaaagaatctttttgccgtccggtgaaaaagagaatccttctatgtctcctttgaaatcggaaataatacggcgttccgtaccgtcaggattcatctcccaaatctggctgccaccactttcattgcataagaatgcgatttttgttccgccttttatccattgaggttcgctttcattccaggctgtttgagtaagcagggtgttgttctttccatcggtattcattacgtaaattacatgatggcttttgttctcgggaacactataataggctacagtgtaggctatctttttgccgtcgggggaaatactcagactgcctatacgtcccattgcccacagggcttcgggggtgagacggccatctttgatggtgatttcttgcttacctataatgggttcgtagccctgtccttcctgctttacttcggtacaggaagaagctagcataagtgctgctgccatgatggttgcgcttgatttattcatatctaaaaattgtttttgatgattaattgactgcaaaaatacgtataaaagccggtgatgtgaaatgttcctgcatatttgttttgtttctttgtgtgcttgtggatggtatctttgctgagaggaataaatatagaagtagctatcgtattattacagaacagcgaagaccgctattctgtaataatacggcggccttcgctgtctttttaagggagtgtaaactcgttatttttttcctttattcattctttcttgttgcagacgctcctgctccttttgcaaagcctccagtttggccattagtccgccaccacctggtttgccgccattcttttggcttttcttttctttccgtgcttccagcatggcaaggagtttcttttcatcagttgttttgcgcagaatcaccatagtgaggataccaatcagtccggaaatgaagtaataataattcaaaccggaagaataaccgttgaagatgaaaataaacatgactggcatgatatacatcattagtttcatacccggcatttgctgttgtcccatatcctgctgtttcatggtgtacatggtattcagaatattagtgatactgaacagcaaacagaagaggcttaaatgattgcccagcaaaggaatgttggttccccagttgataatatcatcataagtggataagtccggggcccataagaaactttgttgacgcaactcaatagcgttaggcacgaagaagaataaagccatgaataccggcatttgtatcagcataggcaagcaacctcccatggggcttactccgtatttgctgtaaagtgccatcgtttcctgttgcttttttaaagcatcctctttcttgggatattttgcattaatctcgttgatatacggtttcaggacgcgcatcttggcagaagacatatatgatttgtaggtagccggataaactaacactttgacgataattgtcatcagcagcaatacgacacccatgctcagtccccaacccgagagccaatcaaacaaattaatagtgaaccagcggtttacccagcggataatgggccatcccaaataaaccagatcttctagttccaagtctttttgggaaaggcttagatcattgctgttcagcaaagtcttgaaatggttcggaccgaagtagaactgcatattggtagactgctttccggtaggatcaaagaaagttgtcatgtctgcggtatagttcttcatatatccgcttccttcctgttggggggtagaggttagggaggctttgtcaaaatcttgatcggcaataagtacgcttgagaagaactgatttttgaaagcaatccagtccaaacgatcagttacatcttcttttgcttctttcatttcgttcagataatctgaacttttttctactggcttgtaggtgagcgaggtatagcgctgctcgaagctgaaacctttttcaagttgacgtgcccgttgacgccagtttatattgacagtgttcagggcaggagggaagaaattctgcatgccatttgcgcgaattgtgaaattcaccatgtaagcatccggcaaaagtttgtaatcgaaatctatatagcctccattgtttgctgccagacgcatggttacagtgctgtctgttacgttggtaggctggaaatacatatcctcggtcaaaatgttttcattctttccttcgaaagcgaaattcatgcccgaatctttttcatcaaacagcatcaaaggcttgccgtcctgtccattatagtcttttaatatggctgcacatacccgtccacctttattggtgaaagtcagttttactacattattttccagtgtcgttagctgttccgcaccttggcttgcgccatagaacatagaggtagagtctaaatgcaatgttgcattctggctctgtgtcgtggcagcctgtgcctgtcgttcggcctctttttgggctatcgcctgaatggaatcctgataatgtttggcacgtgccatttcttcctggctaggacggttgtagatgctgaagcctatcacaactgcaccaatcagggcgaatcccactaaagtgtttttgtccatttttacttgtttaccttattatattataattctcgtttcttatttgtctattgccgctttgataaatgacaggaacaaaggatgtggtttcaatactgtactgctgtactcgggatggaactggactccgatgaaccattttaatgttggaatttcaattatttccactaaatcggattctggattggtacccacacatttcatacccgccttttcgtactcctgcttatagtcattgttgaattcgtagcggtgacggtggcgttcctgtatatgttcgcttttataggcttcgaaagtctttgagtgttggtcaaggatacattcataggcccctaggcgcatagtgccgcccatgttggtaatagctttctgttcttccataatgtctatcacgttgtgtggcgttttttcatccatttcacggctattggcatctgtataacctagcacgttacgggcaaactcaatagccatgcactgcatacctagacagataccaaaagtgggtacattgtgtgtacgtgcatatttaatagcgacgaacttaccttctatgccacgttgtccgaatcctggacagatgatgataccatccatttccttaatttgctcttctacattggcatctgtcagtttctcgctattgatgaagtggatatccgctttacggtcattgtaagtggctgcttgtgacaaagcttcaaggatagatttatatgcgtcttgtaaatcgtatttaccaactaatccaatttttacttttttagttgctttgtgacgacgatctagaaaatctctccatgggccgagggttggagtttcacccacgggcaatcccattttttgaaggatggttacatccagtccttgttcctgcatacgcaaaggtacttcataaatagtgggcatatcgatggactgcaccacagcattttcatctacgttacagaatagagcaactttctttttcaaattagtgctcaattcgtgctcggtacgcaataccaatatgtctggctgaatacctacggattgcaattcttttacagagtgttgggtaggtttggtcttcaattcgcctgctgccgccagataaggaacataagtaaggtgtacgcacaacgcattacgtcccatttcccatttcaattggcggatactttccaaataaggaagtgattcaatatcacctacagtaccaccaatttcggtaatgacaaaatcaaatttatatttgcttcccaataattttacattgcgtttgatctcgtcggtaatatgggggataacctgaatagtttttcccaaatagtcaccgcggcgttctttgtcaataacacttttgtaaatacgtcctgttgtaatgttattggctttagttgtctggatgcccaaaaaacgttcgtaatgtcccaaatcgaggtcggcttcgtgtccgtctaccgttacataacattcaccatgttcataaggattcaaagttcccggatcgatattgatgtacggatcgaacttttgaattgtcacattgtagcctctggcttgcagtaatttacctattgatgatgaaataatacctttacctaatgaggaggcaacaccaccagttacgaagatatacttagtttctcccactacttaatatttttaaatgttattttcttaattatcaatatcgcaatatttatcaaagttgcaaaattacaaaatctttttcaatatcgtcggatatgctttaaaaaatcatttgatgaaattgaatttatcattcgttattatataaaggaaacagttttttgggaaaaggaaaattaagtgtatttttgcacaaaactaaaaatagtatgagaaaaagtatatgtttgactatagtgcttgctgtattctgtatgggagaggcatcggcacagaaagtaaccaagacgaaagaagatccggctgtgaaagccttttctgattcattatcagctttgagcgcatcttattttgcttatttcagactgtgggatgatttgaatatcccggctccccggtgggtacgtcctaatccggctttttataagttgtttgttccgcccacttattatgaagctcctataaaagaaatttttgaaataaaatggagtccggatacgaaaataatgacggctgttgattcgctgtatatggggaaacgcgactctgtatctgctgctatatatcagctgcccgatttggaaaccttggccgctgcagaccgttggtcgaataatatattaaggaattattatttgcaatatccgggcagactggtgaataacgaactttatttggccgacctgaaaccactggaaaataatcagatagtaaaaagaccaaggaaagagaaaatcaaaagtttccttcaaccggaaacaccggtggaaagcttgactacggataatgaattgttggtggtacgtcctaacttttggacgcataaggggaatggatatgttcagttcacacaacattatatttcagataactggtataaaggtggtgaaagtactaatgcgctattgtctggcttggtgctggaagctaattttgatgaccgccagcgtatagagtttgaaaataagctggaaataaaattgggttttgttacagcaccgtcagatacagtgcataaatataagacgaatgccgacttgtttcgtttaaacagtaaactgggtgtgaaagcgttcaaaaactggtattatactttggcgggcgagttcaagacccagttttttgggaattataagacgaatacgaatgatatgatttctaattttctgtctcccgctcaattggatataaccctcggtatggactttaagcagaataagaagaattattcattgtctttgttaggatctccactggcgtatacttttatgtatatcagtaatgataagataactgatccgggtgcttttaatgtggatccggggcataaaacagcaaatcttttcggttcgaaatttacaggtaatctgacttggaaaattattcccagtattgtgtgggaatctaaattggagtactttacaacttatgacaccgtaattgccagttgggaaaatacattcaattttgtattgaaccgctatttgtctactaagttgtttgttcatgcgcgttatgatgacggtgtgacattgactgaggataacaagagttatttccagttgcaggaattgcttagttttggtttgaattatacttggtaaagaggagagtgtaagtgatattgatagaaaatcaataaaaacacggatgccgcagaataccaaatcctgcggcatccgtgtttttatctgagaatggttttctattttatttatgttcatccagcaacgtttgcacaattctttctgcagtgtgtccatcccagcgttccggtaaaagccccttttgccattctcctttattcagcatgtcaagggcgtttgctaagatttcagggtcttcccccactagccggtttgtgccgattgtcactgtttcgggatgttctgcatacgtacttaatgtcatacaggggattcctaaaaaagtagcttcttccgctacgttacccgaatctgtaatgagaccctgggcatggctcactaaataaccgaatgacaaataaggttgcggtggtaatatatataacctttcagaagtaatatctaaaacagacagcttgttttttacatacgtgtggagcggtgccacgatcggcttgtctgttttttccagtatagtgcggaagatagctttcagtgcagtatcattgtttagcaatgaatgcttgttcaaggttagcaagaggtattctttttctttcagtcccataatagagaatgctaccgggcgctgtaagcgagtacggttataacgcagcgtatcaatcagaatgtttcctacaaaatgtacatgtgcttgttcggttcctgtttgattcagattgcggttggctaccattccggccgtgaatagataatcagacaagccatctgttatcatactgtttacttcttttggcatatccatatcgaaagaacgggttccggccactagatgagcaacttttatccccttctttttagccacgatagaacacgccatagtaggagttaggtcatccactacaagtactacctgtgcaggatgttgttccagttcgcgggcgaaagctaccaatatacctgccattcgctggaaaaaatctgtattatccacatgcagatacacatcgggacgcggcatatctaggtctgtaaacagagaaggttccaaacttttatcttcgtccgaacctgtgtagaccaggcgggcagtgatattttttcctgctgcctttgcagctttgatagcacgcattaatggggctattttcatgaaattgggacgtgcaccggcgataattgttactttcatcttattttaagctattttctgaacacaaaaatacattttcttatcgaatttattcgttactttgcagacaaataacaaccattatgctaacatttgttcaagttttagattttataggtacgtttgcctttgccatcagcggtatcagattggcgtctgccaaacagtttgactggtttggtgcgtatgtagtgggtttggcgacggctatcggaggaggtactatccgtgatgtgcttctagatgtgactccgggttggatgactgaccctatatatttaatatgtacaggacttgcattgttttgggtaattgctttcggcaagtatttgattcatatgcataacactttcttcctgttcgacagcatcggcctggcactatttacagtagtgggggtaggtaaaagtattgctctcggatatcctttttgggtagctataatcatgggtagtatcactggggccgcaggtggtgtgctccgcgatgtttttattaatgaaattccgcttatttttcgtaaagaaatttatgcaatggcctgtgtggtggggggattagcctattggatatgtgatctgtttggtctggaagcctttatttgccagataataggaggtagtactgtgtttttggcgcgtattttagctgttaaatatagcatctgtttaccaattttaaagggggaacaacgctaaacagcacctgaaaactatcaaaatagggggtaaaaactgataaatgacggtttttaccccctattttaatagttttttctttgacacctatttaaaatgcgctatccttgcattaccgagagcatggaaaaagaatatgaacctaaactgaaagatttatgaatagcgttagttttaaaaagaacctgctgggtgtgcaagaagaattacttcggtttgcatacaaactcacagccgaccgtgaggaggctaatgacctgctacaagaaacttcattgaaagcgctggataatgaagacaagtatatccccgatacaaactttaagggatggatgtataccattatgcgtaacatctttataaacaattataggaaaatagtgcgtgaccagacatttgtggaccatacagacaatctctaccatttaagtatgcctcaggattccggctttgatagtaccgagggagcttatgacatgaaagaaatacatcgtatagtcggcttgcttcccaaagaataccgtattccattcgctatgcatgtgtcgggattcaaatatcgtgagattgccgaaaagttgggattgccgttgggtactgtaaaaagcagaatcttttttaccagacaacgcttgcaagggcaactccgtgattttgtataatccaaagggaaaaattatcaaaaaggtagagtgaaattcttttgctctgcctttttgtttttattggtttacaatatgatattaaacatgtttttggaagctaaaaaatagattcgaatattaactttatttttattcatttgttatatttgcaaaaggacaagacacctttaaatcaagtaataattatgaaaaaagaaatcaaattcagtttggtctaccgcgatatgtggcagtcatcagggaagtaccagcccagagctgatcagttagccaaaattgctcctctaatcgttgaaatggggtgttttgctcgagtggaaactaatggaggtgcttttgaacaagtgaacttactgtatggtgagaatcctaacaaggcagtgcgtacatttaccaaacctttacgtgaggcgggtattcagacgcatatgttggaccgcggtttaaatgcattgcgaatgtatcctgttccagctgatgtacgtcggttgatgtataaggtaaaacatgcgcaaggcgtggatattactcgtatattttgtggcttgaatgaagttcgtaatattattccttccataaaatatgctaaagaagcggggatgattcctcaagccactctttgcatcacttattctcctgtacatacggtggattattattcttatattgctgaccagttaatagaagcgggggcacccgaaatctgtttgaaagatatggcaggtatcggccgtcctgaaatgttagggcagttggtgagaaacatcaaagataaacatcctgaagtcattgtacaatatcatggacattccggtcccgggttatctatggcatctattttggaagtttgtgagaatggtgcggatatcattgatgtcgctatggagcccttatcatggggaaaagtgcatcctgacgtaatttctgtacaggctatgttgaaaaatgcaggttttcaggtacctgaaatcaatatgaaggcttatatgaaagcacgtagcatgacgcaggagtttattgatgattttttggggtattttattgattctaccaataagcacatgtcttccttgctgttaggttgtggacttcccggtggtatgatgggatctatgatggccgatttgaaaggtgtacattcaggtataaatctacttttgaaaggacagggaaaggaacctatgagtttggatgatttggtagtgatgctgtttgaagaagtggaatatgtatggccgaaattgggatatcctcctttagtaacaccgttcagccaatatgtgaagaatgtggctttgatgaatgtcatgcaattggtgaaaggagaggagagatggacgatgattgataaccatacatgggatatgattctgggaaaaagtggaaagttgccgggtgcgttggctcctgaaataattgaactggcgaaaagtaaaggttacgagtttactgacgaggatcctcagatgaactatcctgatgagctggacaagtaccgtaaggagatggatgataatggctgggaatatggtgaagatgaggaagagttgtttgaactggctatgcatgaccggcaataccgtgattataaatcgggtgtagccaagaaacgttttatggatgatttacaacgtgctcaggatgcggctatggtaaaaagtggctttgatgaggaaacaattcgaaaatataagcgtactaaggctgatcctattattgcgccggataagggacagattttatgggaagtttccgtggaaggtccttctatagcaccgtttgtcggacggaaataccagcatgatgaagtgttttgttatatttccactccgtggggagagtatgaaaagatctttactaattttacgggacgcattgtagaagtttgcgcccaacagggagctgtagttaataaaggtgatgttatagcttatttggaaagaacagagtttactgcatgatttgaaggtaaaatatagtttttttatccgctgtggcaggtttgaatttgtcatggcggatgtttttatcttttcattcttttaaaatttgcattcattcagttatgtgttatctttgttgccatgcagaaaaaacaggtagataagaaaaaatatatgagaaaactgtattcgtggttgctgggaataattttaggagtaatgccctgtattgtttcagcatcagaaaatgacagtataaaagtcgagagtctgcttcaaaaagctgcccgattgccggccgatagctgtaagatattgttttttgcccaaaatctattaggagttccatacgtagcgaatacattggatgggacagatgaagaaaccttagttgtgcatttggataaggtggattgtaccacgttagttgaaacagtacttgcattgagccttactgataagtatgggaaaagtgactttgaaagttacaaaaaagcgttgcggtgtatccgctatcggaatgggaaacaagccggttatgtctcgcgtttgcattacttcagtgattggattaaggataatgaacaaaaaggaattgtacatgaacgcacgggggaattagggtttgctgcatcacaagttttgaatttggattttatgtccacacattctgacagttatcatcggttgaaaaataatccttccatgatatcccagatgattgaaatagagaaaaaatggaaaaatgttcctgtttcttatattcctaaaacaagtctgaatgtttcttctgaggaattggacataaagaatggggatatcatagcgattaccaccaatataaaagggctggatgtggtacatacaggatttgcttgttgggtggatggtaaattgcatttgcttcatgcttcatcggtcatgaagaaagttattctagattcgcagactctctttgaatactctaaaaataagaaagcccacacgggggtgcgggttatttctttttcttctttgaaaccgtagaaggtatatcttgttggggtggaaatatagggacgcatttcataagataaaggatcttcttttgtcttttgagcatgtagttgccaggtctgcttgaattgaacttgcgaggattgggaaggctggctgcaattagtgcacattcttccggtgtcagtttgctggcattcttgtgaaagtgttcacgagctactgcttcggcaccatagataccatttcccatttctatagagttcagatagacttccataatccgttccttattccaaaatagttctatcaaagtggtgaaatacacttcaagtccttttctgatccaagaagaagcaggccacaaaaaaatgtttttggctgtctgttggctgatagtactggcacctcgaggacgttttcggttcttgttttcttctaaagctttctctatttctttgaagtcaaaaccattatgctcggcaaagcgattgtcttcagaagcaataacagccataggcagatgaggggatatgttttctttaggtatccaagagtgtttccactttatatcttcgccatgaatgatttgttgggtagttcggataaacatcaacggggtaaagtaaaccggaataaagcgtaaaacgataactgcgagaatggaagaaccaaagaaaaaaagcagcagattgcgaatgaattttaaaatcttttttttcatgcttgtgtattaaaatcaatttcgggcagaaataacctgtccgaaattgatttattttatatgttatccaaagttgtgaccgttggttcgggcgtattggatacgctctatgataacgtcattgatatcatttcagtgtacctgcttccgcttgctgaatcatctgttggctggcatacatatatacttctacacgacgattctgctggcgtccttcggctgtgtcattattacctatcgggtctgcttgacccaaaccttctacagacttgatctgagaattacttacaccgcaacctagcaaataactagccacactttgagcgcgttcttgtgacagattgaggttcttttggatgctttgttcggctgtactgtttctccagccctgattgtctgtatatccataaatggatacgtccatatctctgttctggttcaatacgttgtttgcaaatttacttaaggctgatttcgcttgtgcactcaaggctgcatttcctgtattgaagagaataccggaatcaaaagtaacttttacagcctgaagaccgttgttatctgttacctgttctacctgtgctccttggatttgagccgcttcttctgccgctttatccattttttttccaattaacacgccggcgcctgtacctactgccgcacctactgccgcaccaatagccgcacctttaccatgtccggctattccgccgataattgctcccaaagctgcgccaccaccgccaccgatcagaccgcctttagcggtattattcatgttaccacatccactgaatactagtgttgcactcagtaataaagccataattttagtctttttcataatcatgttcattttaatatattaatgacttaatgcaaaaattgttcattaaacagcctgataatttaaagctttcttcttgataagtataaaccagatcagacaaataattcctttcatagtgctagtgatgcttatgctccaccaaatacccggcaaaccccagccccatgatacaaacaataatgccatcgggatgcgcagatagttacaggtgacactgattacggcaggaggcatggtgcgccccattccataaaaaacgccctgtatggtaatttccagcatcataaatagttgcgagtatccgtcgatacgtagaaatacgccaccggtttcatacgccgctttttcaggaacaaagatagaaaatatttcgtttccgtaacatataaaaagaaatgtgcagaaagatccgaatataaatgtcatccataaagtggtgcgataggctttcagtacacgggagatttgccgtgctgcatagttctgagctacaaaagcactgagagctgtagaaaatccttgggaggtgttccaggtgatagcttcgatttgtcctccggtagtgagtgccatcagccctaaatgaccaccttgctctgttgcggtccttccgagaaacatattgacgaaagcgaataatgtattgagtaccgctactggtaatcctattttcaagatgtggtgtgtatattgtttttttagtgtagtaaataaccgaaagtcatcccataatattttcttttgtttcaattgatagataaacagtatgcataccgtagcttcggccagccaagtggcaattgcggctcccgtagttccccagtttaaaccaaagataaaaagaggatctagtatcatatttgtaatcagtccgataccgttaatggaaaaaggtattttgcttcgtccggcggcattgaatatccctgtaaaggcagctgataaaaagacgaatggaaaggcagttgctataatccgtagatattccccagccatcttggctatatgaggttccagttcatagatactgataataggggtggcaaagataaataacaatgctccccagcttaatgatataagtaaggacaaggtaagattatgtgatgcgaacgcacgggtagcttgttcgttttgtgccccgatggcttgtcctacgctgacttccgaaccaactttgttcagcagggagatagatgtggacatccatgtaagaatacccactgaacctacagcggctattgcctcacttcctattcttcctacccaggccatgtcggtcaggctatatgccatctgtatgaatgaagtggccataatgggcattgccaaagtaaacaattgcttcaggatagggccttgagtcagattcttagttcctttcattcgtcattaacggataaattgtctgcaaaggtagaaatttatactgatttctgtggggactgctgataaaaatacttttctattactctttttaaatggtctggatgtttcataaaaaaactttgaagttcttgaagaaggataaagctttttcaaaaaacttcaaagttttttatgagtatattgatagaagtcgttaattagtaagcgaaaataggatatttcttcattgtttcgtttacgcgtgcacgaacttgtgcaatcacttcttcattgtctacgtttgaaagaacagtttcaatcatttcggcgatttccaacatcaagtcttcttttgcgccacgagttgtgatggcaggagttcccaaacggatacctgaagtttggaaagcagaacggctgtcaaatgggaccatattcttgtttacagtgatatcagcagcaaccaatgctttttctgctactttgcctgtcagatcagggtatttggtgcgaaggtctaccagcatggagtggttgtctgtaccaccagaaacgatcgtaaaaccacggtcaatcagagcctgtgccaatacggctgcattcttttttacttgtgtttgatattctttgtattccggctgtaaacattcaccgaatgcaacagctttggctgcaatgacatgttccaacggaccaccttgtataccagggaatacagcagaatccaaaagttgtgacatcatcttgatttcgcctttcggagttttcttgccccatggattagggaaatctttgcccatcatgataacaccgccacgaggaccgcgaagggtcttatgcgttgttgaagtaacgatatgagcgtatttaaccggattatccagcagtccggcagcaatcagacctgcaggatgagccatatcgatcatcaggatagctcctattttatctgcgatttcgcgcatacgtttgtagtcccattcacgagaatatgctgaaccgccaccaataatcattttcggtttttcacgtaatgcgatttcttccatctggtcgtaatccacacgtcctgtttccttgttcagattgtattcacatggagtataaataatgccggatgtgttaaccaatgaaccatgtgacaggtggccaccatgagccagatttaatcccatgaatttatcacccggatttaaaacggccaagaatacggcagcattagcctgtgctcctgagtgaggttgtacgttagcccattctgcgccgaagatttgtttcagtctgtcgatagcgatttgttcgctctggtctaccacttcgcaaccgccatagtagcgcttgccgggatacccttcagcatacttgttggtaaggcaagaacccatagcttgcattacttggtcactaacaaagttttcggatgcgatcagctcgatacctttgagctggcgttgatgctctttttcgataatgtcgaaaatcaaatcgtctcttttcatttctttttataataagtttatgtgcgatattcgattctgagttcacaaagttaagtaattttagaatataaggaaattatttagaagaaaatctttagtggaattacagaaaaaacacgtgtgactttctttttgtcgtttcataggaagtaaaataccggaaatggttgatcctcagttctattctttggtggaaaactcttcagaatgtaatattatgatagatgtcggaattcttacggaggagtatgactgcttaaaaaataactcctagagagaaacttaatacattgcgatgacgattgatgaagatacctttttcctgaaatatgactccatctatattcttttcgtaagtgattgatttggatatattggttagtccgatttcataccggaaatcgaagaatatatttgcaatattcacgcctaatccgataacggaacttatattgatagggcgtaattcttcttttatgccggaatgcccgaacccttcaaactcttcatcagtcttatgtttccatacatattctaatttggggccgataaaaagtgccatgccgtaaggacggctttttacgaaactatagccatatagtataggtaattccaaagaatgaattgtgctgttcagtttggcaaattcgggaagggtattttcattattctgattcttattgaaagctatttcacctttatagacattatacataatttcgggttggatgaagtgtcttttcatgtgtacccggaaaaatagggcggcgaaatagcctaccttataattattttgcacatcttccatacgttctccgtctaactccagcctgctggtaaagtacatggaagaattgaagcctccttttattcccacattgattttaggctcttcttgcaaacctttcttctctcctcgtaccggaacggataaggtgaggagcaataaagcgatcaataaaaggagtttcttcatgaggtgtctttaggctttttctttggtccgcatcctgttcttttctacagaccagccgaactttccgattttcggtcccagctcaaaatagccaccatgaacatataccagcggattagcttgggataattcgaattttcctgtttctccgttcaggtatttgtcatcagctttcacatttaccacatcggcaataaacatatcatgagatcctagtgagataatttcttttaccctacattctatacagagtggagattcctcaataataggagcattgactattttcgcttttcccggagtcagcttcatttcttcgaatttattataatctttgcccgaacgcactccgcaccagtcggtggcaaatgccatctctttagttgtaagattgatgacgaattccatgtttcgtttcaagatgggataggaatgacgctccggacgtacggatatataacacatggcggggttggtacaaatagtacctgcccatgccactgtgataatgttatattcttcgtccgtactcccacaactgaccaatagggccggaaggggataaatcattgttcccggtttccagtcttgtttcataatgattaaatcagtttaataccttccttgctttgttccttctcgcaatagtggcattttaagatgccgtgttccttgtcgattacatggaataaagtgatcatcggttcattattggtgatacacttgggattggcacattttacaatgccacgtaattcctgaggcatcaggacttgtttcttttctaccacctcatagtcacggataatgttcagtttcacattcggggctactacggaaaggcggcttatttcctcatcagtaaaaaagcggtcggccaccttgataattccttttttacctagctttttgctctcgaagttgtttccgatggttatgttagagtctgaatcctgtaatcccaatagggcgactacagtaaacaatttatcggaaggtatatggtctataacagtgccgtttttcaaagcggctacctgcaatgcttgtttattatcgctcatcttcatttttgttttttacttttttgcatcttctataacatcgttcaaggttatgcccaatacatcacaaaggatggcctggcgcgcataaagtccgttttgtgcctgctggaaatagtaagctttcggattctcatccacatcgtaagctatttcgttgacgcggggcagagggtgcaggatacgcagattggggcgggtatgctccagcatcttattccttaatatatatacatcttttacacgttcatattccatcaggtcggtgaaacgttcgcgctgtacacgggtcatgtaaagaatatcggcatctgcgatcgtttcttcgttaaagtctgtatattctttgtatttaatattgtgctccttgcagtatattttatattcttccggcattttcagctcttcaggagcaatgaagtggaaagtgggattgaagtgacgcatagccatcagcagagaatggacggtgcgtccgtatttcaagtcgcctaccaaataaatgttcagattctcaagcgttccctgtgttttgtatatggagtagaggtctagcatagtttgtgacggatgttgattagctccgtctccggcattgactataggtaccggggcaacttcactggcatatcttgcagcaccttccaaaaaatggcgcattacaataatgtcagcgtaattgcttaccatcatgatcgtatctttcaatgtttctccttttgaggaactggtcactttaggatcggtaaatccaatgacgcgtgctcccaatctgtttgctgcggtttcaaaactgagtcgtgtacgggtggagggttcgaagaaaagagtggcgactactttgccatccaaaattttacggttaggcttcttttcaaactcttttgccatctccaggaggtagaggattttctctttcgagtgttcggcaatagtaactaaacttctattttccattttggcttgtatttataattacaacttatacggagtgtaaaggtatgaaaaaaaaataaatgagcgaagatttaaaagatatttcgttgaactttgttagaaacacattctatctcaaagtttttccttacttttgcatcgttaattactagaaaacgtcatgaggaagaaatttatatatgtgctttgggctcttgtagtcggcatactgttggttatagcgttcatattcaccgcgatagcaaaaggatggattggatatgtaccccccattgaagagttggaaaatccgaatttaaagtttgcaaccgagattatatccgatgatggcaagatgctgggcacttggtcacttagtaaggagaaccgcgtatttgtgggttatgaccagctttcaccgaatctgattcatgcactgattgctaccgaagatgaacgttttgcagaacattccggcattgacgcccgtgcgtttatccgcgctttggtgaaacggggggtgatgatgcagaagaatgccggtgggggtagcaccatcactcagcagttggcaaagcagttctattcacctacggcggataatgtgatggagcgtttgttgcagaaacctatcgaatgggtgattgctgttcagttggaacgttattatacaaaagaagagattctgaccatgtatcttaataaatttgattttctgaataatgcagtcggtatcaagacagctgccaatacatatttttcaaaagagccgaaagacctgaacattgaggaagcggctaccttggtaggtatgtgtaagaatccttcactttataatccgaaacgttttaatgaacgttcacgcggacgccggaatgtcgttcttgaccagatgcgcaaagcaggttacctgactgatgcggaagctgattcattaaaggcattgccattggtcttgaaatatcgtcgtgtagatcataaggaaggactggctacttacttccgtgaatatctgcgtggagtgatgacggctaaagaaccgaagaaaagtgactaccgcggatggcagatgcagaaatattatgaggattcattggcttggaagacaaatcctcttttcggttggtgtgctaaaaacaagaagaaagatggtactaattataatatctatacggatggtctgaagatttataccactatcgactcacgtatgcaaaaatatgctgaggaagctgtttacgaacatgtggcgcagtatttgcaaccccgcttcttcaaggaaaaacggaaaaagaaaacggctccgtttacgaatcagctgacagaggcagaagtgaattctatcatgaccagggccatgaagcagactgaccgttatcgtatcatgaaagaggcagggtgttcggaagcagaaataaagaaagcgttcaatactaaatatgaaatgtccgtattctcatacgagggggaaaaggataccattatgactccgatggattctttgaaatactataagttcttccttagagcgggattcatgtctatggatccgttgaccggtcatgtaaaagcatatgtgggaggacccaactataattatttccagtatgatatggcgatggtaggccgtcgccaggtgggttctactattaaaccttatgtatatactttagctatggagaacggtttttctccctgtgaccaggtgcgccatgtagagcagaccttgatagatgaaaatggccgtccatggtcaccgcgtaatgccagcaagaagcgttacggagagatggttaccatcaaatggggcttggcaaattctgataactgggtaacggcttatttgatggggaaactgaatccttatcagctagttcgtctgattcattcatttggtgtacaaaataaacagatagatccggtggtttcactttgtttaggcccttgtgagatttctgtaggagaaatggtcagtgcttattcggcatttgctaatcggggtattcgtacagcgcctgtttttgtaacccgtattgaggataatgaaggaaatgtgttggcgaatttcactccacaaatggatgaggtgattagtgaaacaagtgcttataaaatgttggtcatgctgcgtgcggtcatcaatgaaggtacgggtgggcgtgtacgccgtctatatggtattactgccgatatgggaggaaagacaggtacaaccaaccgtaattctgacggttggttcatgggattcaccccttcattggtatccggtgtatgggtaggtggtgaagagcgtgatattcactttgatacgatggtggacgggcagggggctgctatggcacttcctatctgggggctttatatgcagaaagtctataaggacaagagcttgggatactctcaggacgagaaattcaatattcctgatgactttgatccttgcaaggatactttgatagatgaaacttcggtagaagaaaccggaggattggacaatatatttgagtaattagaagattagatttataagtacaaagtctgtttgcaagaaggaaagcaagcagacttttttctatatatacttttatgaactattacttttcctgttcacacggcagtttatattatagaaaataatttatgtaaaaatggtgaaaacccttgtcctttcatcgaaaaatgctatatttacgaaaagaaaatctttaccttataaagataggaggtaactatggatagagatgtaaccctatatcagatcactagcgttatggccgagagagtttttcaaaagatagacaacttcaataaaggccgtagagaagatgcgggattttatgcaatcagtgtttccactccttatcgttcgtattatgctttatggcgtatatttccggataatacttactctcctctgtttattcagtcgttggcagttacatttaatgatgcggcagagcgtgcttttcagtatttgcagaattgcaatgtcctgctgaaagtgaaggataacactttctttgaaccttattatggtctgtccgaagatatagttgcatttgggaagtatcgtggaaaaaggttggcggaagtatattatattgatcctaactatgtgctttggttggcacataagtttgaagcccgtaaccccagagacaaaaagttagcagtattggcaaaggcttttgccacagttcattatgaaacggtcatcagaaaacatcatttgccggctgggagtcgttttatcggtcagccgggagaaaggctgaccgatttacatctggaagtcctggggacaagattacaactagatgcttataaaacgactggatactatgtagatcagagtgtacttgctgctgatgctgatggtaatcgttatacttttatcataaaggcagctgcttccagtatgtcaccggagatgctgagctgctatacaaagaaaatcaatcctcatgaaagtctatatattaaatcggccaaagtcctttctcattatgagagtaaaggaattaaatatactcgcataggatatttgaaatttaaataatgtctggaaaacaaattcccccacctttggattggcgagggaacgttttttattatccgtttacctttttataatcggccaggaatttttctaatcctatatctgtcaatggatggtttagaaggcctttaatggcggataacgggcaggttactacatctgctcccacttccgcacattgtaatatatgtaaggtgtttcggatggaggcggcaagaacttgtgtcttgtagtcataagtttggtacaattctacaatttgtgcaaccagtcctacaccgtcattacaaatatcatccagtctgccgacaaatggagatacataggtagcccccgcctttgccgcaagtaatgcctgtccggcagagaaaaccagtgtacaattagtgcggattcctttattactgaaatatttgatagctttgatgccgtcctcaatacaaggaacttttactacaatgtgtgggttaagggcggcaagttcttcgccttcacgaatcattccttcataatcggtagcaatcacttcggcactgacatctccatccactatattacatatttcaatgtaatgcttatgttggttctcaactcctttaatgccttctttggccattaaagacggatttgtggttacaccatccagtacgcccaatgcatttgcttcgcggatttgtgccaggttggctgtgtcaataaagaatttcataacttttttctttttgataattaaaaatcaggttagcaacagattgctaagctactgatattaacaatgataaacaagtaaatgttccgatttatctgttatgaattctttttgtagctgaataccgcccaaccgttcaaagcgatggccataaggaacaaggcgataaattgcataatcaggtcactgaatccgcttcctttcaggtaaaccatacgtgttacctgtatgaagtacttcaaaggattggcaatggttatggtttgtgcccattcgggcatactgttgatgggagtaaacaacccgctcatcagcatgatgataatcacaaagaaaaacatgacaaacatggcctgctgcatggtttgggaatagttggaaactaccagccccatgcccgagataacgataatgaataataatgcaaagaaataaagcagccataaatgaccggccggaaccagaccataaactaaccatgccagaatgataccgattgtgaggatcagtatgccggctatccagtaaggaatcagcttggccagaatgaaagtgaatttgcttacaggagtcacattgatttgttcgatggttccgaattctttttcactcacaatattaagagcaggcagaaagccgcataacatcatcaacaattgtgccatcagtgccggaaccataaataccttataatccagataggggttgaaacgtccttgggtatctatgtttatcaccggggagggagaaatagagccggaatgggaagcccggatttcagtggcataggcattcactatattactgaggtaggaacttcctaaagttcctttcgttccgtttacggtgttggctgaaaccagtacttttgctacaccggttttcagcaaatcgcgttcgaagtgtggcgggatttccaaaatgaggtcagcatctcctttttcaatgcattgcatcgcttcctggtaactgtttgaaacatctaccagatgaaaatattcggaagctcccaccttctgaaccagtcgggtggaatagggactgcggtcattatccactacgctgagattcatattcttgatttcaaagtttgcggcccaaggcaacaccagcaggatgatgcagggaaatacgagcagtatccgcggaagcatcgggttgcgcagcagttgcttgaattctttttctaataaatactttatcatatcttccggaacttattctaatcgtttgttaaacttttttaggctgatgagtaaaaggataacagccatcagcataagtatacccatttctccctgtgcataactgatactcaatccttcaatcatgattttcttgattccgacaatataccatctggcagggatgacatttgaaatcagctgtaaaggaagaggcatattctcgatggggaatatcatgccggaaagtagaacggtaggcatcatcagtaccattcccgaaaacagcatggcttccacttgggtacgggcgatagtggaaaccaataatcccaacagcagagatactacgatgaagatccatgagagcaaagccaacgaaaaaagactgcctgctaccggaacatgtaatacataaacagacagcagcagaattgtgaccagattgacgcatgacagcacaaagtaaggtaccattttggctataatcatccatagcggacgtacgggagataccagcaatacttccatcgtaccggtttctttttcacggacaatagagatggaagtcatcatggcgcatatcaacattaaaatcaatcccattactcccggcacaaaattgtaggcactttgcatacccggattgtacaataactttatttgggggataatctgtatgggtgattgttgttgcatgatccggctttgctgataatctgcaataatattggatgcgtaagaggtcagtatggtagcattgttgggatcggtggcatcggctatcagttgtactcgggctttaccggtatgccgcagattgttatcgaaaccggcctcaaacacaatgaccaggtctgaactgcttttccggagtgtttcctctatctcgtcgttgtcatatagcatcttgttgacattgaaatagtcactggcatccagtttgtcgatgatttgccgggtggatacatcttttgagaaatctagcacggctacttttacattctttacttcggtggtgatggcaaaaccgaaaagaataatttgtacgacaggcatacctagtaatatcagcatcgtccggcggtcccggaaaatgtgatagaattcttttcgcacaaatgatataaattgtttcattctctttttctctatctctttttcaacttcttacggccttgcgtgccaattgtctgaatacttcatccatatcttgggcatggaaccgttcttttaaccgttgtggggtgtccagcgcttcgatttttccatccaccatcattgaaatccggttacagtattccgcttcatccatatagtgggtggtaacgaagacggtgattccccgttctgccgcctgataaatcaattcccagaactgccggcgtgtggcagggtctacccctcctgtcggttcatccagaaaaacgatcttcggctcatggaaaatagctaccgagaaagccagcttttgtttccatcccaagggaagtgaccggaccaatgtgtttttctcattcaagagtcctaattgttccagcaccttgtctgttttctcagcgatctccttgtcgctcattccataaatccctgcatatagccggatgttttcccatacttttaaatcttcatacagtgagaacttctggctcatatatccgatcttttttttaacctgctcgtattgcgtggctatgtcaaagcccgctactgtaccttttcccccggtaggttgtgataaaccgcataacatgcgcatggctgttgtttttccggcgccattagcacctaggaaaccaaaaatctctccctgtttcactttgaatgagatatggtccactgcagtgaagttgccgaattgtttggtcaagccttctacctctatggcgtatcgtccggtgacttgcggttcattaaaagacagcccttcaggagaaaggatcgaactgaactgttgaagaatacggtccggagtgtcaatgccttgaatctttccttcacgaataaatgcaatacggtcacagcatttcatctcgttcaggtaaggcgttgccgcaatgatggtaagaccttcttgtttcaatttcagcagcatgtcccagaactcctttctggatacagggtccacaccggtggtaggttcgtccaagaacagaatggaaggcctgtgaatcagtgcacaactcagagccagtttttgtttcatgccgccggatagttttccggcacgccggtgtttgaaaggttctatttgttggtagatatcctttaccaatgcgtagttctcccggatagtggtattgaaaagcgtggcaaagaaagtgagattctcttctacggacaaatcctggtataaggaaaaacgtcccggcatatatcctgcctgccggcgtatctctttgtaattcttcaccacatcctgcccgcagacttccgctttcccttcatcggctagcaccaatgtggtgagaatgcggaaaagagtagtctttcctgcaccgtccggtccgataagcccgaagatttctcccggtttcacctcaaagcatacatctttcagggcttgaacttcaccgtaacttttgctaactcctttgacagaaacgatataatccattgtcttatttatttcttcatttctccgtacatgcctatcttgatgtatccgtcattctttactgctatttttgtggcgtataccagattggcgcgttcgtcacgtgtctggattgttttaggggtgaattccgatttgtctgaaatccaggtgattgtcccttcgtattcccggcggtcatcttctcctaaatcagaaaacacttttactttatctcctaatttcagttgagataattgatcggcggtgatataggcgcgtaaaaaaagatgttgcacatccgccactttaaataaaggttttccttgcgtggccagttccccggcttcggcatatttggccagtactgttccgcaaatcggactggtaatgtgacatttgcgaagctggtcatccagttgggctacttgtatttcgtaggccgagctttcttctgtgatactggcattgccgcgttgaagcgtagagatctgtgcttccaactgttttttcagaacggcaatctgggagtcaatatcatctatttgtttttgggtggcggcattttccttcagcaagttttctgtgcgttttctttcatattcggctttgccgatttgttcttttgtggcagctatctgtttattgatgtccgtgcttttgctggctatcgctttaccgctggccagtaactgcatctttttcaaatagagttgtaaggtatctatacaccccacttcttcatcggcctttaataactgtccttcttctatattgaattgcatgatcttgccattggcttcggaggatacaattacttcggtagcttcaaatgtgcctgatgcatcatagtcgcctttcttgtttccgcaagaggataaactgaacagagtggcggcaagcaagatatatttatttgttctcatattggtttgttgtatattttaattcgtaaatggctgataataactgaatttcatgcaggatcttatcctgcctggcaatgttctcggctgttacttcacgtagcatttctgtaacggtcagtgttccgttggcaacttttgcttgggctgattttttaatgttgttacgtagggtgataatctcctcatcgttcttcatcagttccgtcagtttcttaatttcactgttgttttgagtgatttccagatgagtgttaaacaagaacgtttctttctgtacgttcacatcttgttgattcagtattaattggcgagattcattcttgcgagtatataggttactgaagttccaggaaaggcgtacgcctgctacgtaataggccgaaaattcatttttcagcatattcagtcccgggttgccgtatgctccttgtacaaatatgcctaacctaggcaggttcttggcggtaagttgtttacgttgcgcctccagttgctgattttgtgccgcaaacaagttaagttccggacgtcggatgaattctgcagaataggcttctcctttatataataaggcatttacatctggtttctttagtgtgttcccggttaaaggagtagggtggttaatcatgatcttcaacatctcgctgtaagcacgatatgtggcttccagagtatgacgttgctgtatgttgttcaattgttccacttttacagcatccaaatcagcttgattggcaataccattctttacatacgctgtaacgttgtcataattcctttgtaattcttcctgcataagctggttttgcttcaattgctctttcaataacaggataccaaaaaaaagttggtttacccgttcgttgatggcatacatgtccacttccagtttctgtttgtccacttcggatgtggcacgggttacctctttccgtgcccggatgttaccaccgtcccataccacttggtccagttgcagcatggcttggtattgatccttgcgcataccgcgaatatcaattccgggtaggtcaacgggtatttccgttacatccgattgataactggctttggcggataatgaaacttgcggcagataacccttgtcagcgttagagatattgtattctttcgtcttttcaatcagcccgtaccgtttaatcagcggataatgtgcccgggcttgctgctgacactcttccagcgtgagttcctgtgcattcaaacaaatgggactgatgcaaagaagaaaggttgtgagaatgaataaccttttcattttcttaatctgcttaatatgatttctacattttcttgttttctgcgttccatatattgatgatattcttcacctttttcttccacaaacaattgtatcagtgggtttgccacaaagacgaagatattgagtgaaatggcgctgaccattaaatcttccgctttgacggggcgtactgtgcctttctttatttcctcttgcagtgaccggtcgagcagactgattgctaaccggaaattagggaacaaggttttacggcaaatttcttttccgcattcattggtcagaatctccctgtatataaataaaggtagttcgggattagcagtcaaaaggtcgaagtgtgcttcaatgaaacattttattttctccaaaaaaggcaatgattcatctacacgagaaaggaatgtatcggccagttgcttggctttttcttcaaatactttgttgaacagattctcttttgtacggaaataataatgcagcatggcatgggttacaccagcctccttagctatttctgttgtcttgcttccggagaatcctttcttaaggaattctttttcagcggcttttagtatggattgttctgtattgctcgtttcttctttcatattatcatatttgtttaacagaattgttagtaaacgcaaatgtataaggaatcattggaaacaacaaacagatgaagtgaaaaaaatgtgttctttagtttttattaaatgttttttcaaggaaggctaacctctttttcttggcaggttaaggcttttttccctgttgtgttctatctccaaagcttatggagttaactccaaaggctgcggagataactccaaaggttatggagataactccaaagcctatggagatagaaatagaacggccggaaagccttagccttcctggtagaaagccttaggtctgccaatgaaaatacttagctgttttcccacctgtcaggctggccctttcagtaacactatcgtttgccgtagggggatatggaggcgggttatcacaaggtgaataatgattaatatataaaaggtataaattctaaaaaagcacagacattccacggcggatatattctctttccatatcttccggtttcaatatcttattgtcaaagaccagtaggtcaatatccagttttactactccttgagccttgtcttcaggaatccgtccgcagcgtcgttccaattctttaaacaaatcatgaacagaatcgggtgaaagcgttgtgctgaatttggccagttgattgctgaaaggggagtgaaagccgctgccaacagcttccgtttccatcatctcgccgaaatgaatatcaggaaatgtggcacgtaatgcttcccgtgcaaccgagagttgcgcgtaacggtttgtattagagcccatacaaagcaaacaatggtgttcgtccataacatttattgcattaatggtgcaaatgtatgaaatgtttttgttacttttgcatgaatatataaaagaaatggtaccatgaaatttattggaattattcctgcgagatatgcctcaacacgttttccggccaaacctttggccatcttgggaggcaagcctgtgattcagagagtctatgaacaagtagccggtatattggatgaagcatacgtagcgacggacgatgaacgcattgaatccgccgtaaaagcttttggcggaaaagtggtcatgacctccgttcaccataaaagtggcacagaccgttgttatgaagcgtataccaaagtaggacaaggatatgatgtggttgtaaatattcaaggtgatgaaccttttattcaaagatcacagcttgaagctgtgaaagcttgctttgaagattcggctacacagattgcgactttggtgaaacctttcactcccgaagacgggtttgaagctttggagaatgtaaattctccgaaagtggtggttaataagaatatgaatgctttgtatttcagccgttccgtcattcctttccaacgtaacgcggagaaggaaggctggctgaaagggcatacttactataaacatatcggtctgtatgcttatcgggccgatgtactgaaagaaataacttcgcttccacaatcttcgctggagctggctgaatcgttggagcagcttcgttggctggaaaatggttatactattaaggtgggaatcagtgaagtggagacaataggcattgatacgcctcaggatctggcacgtgccgaagcatttttaaaacagagggaggggaagtaaatgctggacagaaccaccccaccgccaatccgccaactaagcgaattcagtataacccgtcccgacaggaggacgatgaagaatgggatgcctctgaatatcattcatgcgggaaccgaggatgttgtacgttttgatcttctgataggaggcggacaatggaatcaggaacagccgttgcaggctatgttcgccaataggatgctgcgtgagggagctggaaatttaacgtcttcacagattgcggagcgattggattattacggagcctggctggagttatcttcttccgtgaactatggattcataacactttactctctgaataaatattttgcccgcacgctggccgtcatatccgagatgataaaggctcctacgtttccggcaaaggaactttctgtggtggccgatacgaacaaacagcaatttctggtgaacagtacccgggtggaaatgattgcccgaaagcagttgaatacagccttgttcggtccggagcatcctttcgggcgctatgcggtagcggaggattatgaccggattaccccggaggtgctccgttcgttttatcggaaatattatcattcgggtaattgttcggtatatatttcgggaaaggtcacatcggaaattatccgttgtatagaagataacttgggaagtggacaatggggggaagtgacggaaaaagcaaagacaacgcttgttcctccggttaccaccaaagaaaagcgtatctttatagaacgtgaggatgcacttcaaagttccttgaaaatgggatgtttcgtaatggaccgtcatcatccggactttttgaaggcacgtgtcatggtcactttgttcggagggtatttcggaagccgtctgatgtccaatatccgtgaagacaagggatatacatacggtatcggcgcaggcattgtgtcctatccgggaacgggaatactgactgtcagtaccgaggcggccaatgaatatgtgaattctatcataacagaagtttattgggagatggacaaattgtgtaatgatctcgttcctcaagaagaattggaaatggtgaagaactatatgctgggcgatttatgccggtcgtacgagggacctttttctttgtctgatgcctggatttatatagaaacggcagggctggacgaacgcttctttatccgttcgctggatgccatccggggaatcaccagagaagaaatacgcatattggctcaaaagtatttctgcaaagaaaacttaatagaggtcattgcgggtaaaaaagtgtaataacctatcatgtccaaagatagaaaatcgtatctttggcgtaaatcttatctattataagtaacgaaccaatgaagaaatacatatatatattattgcttttggcatcggtcagtacattggccaccgctcagataaaaatcgggaattatacttttaaagacgggggcgaatataccggagagctgaaaggtagaaaaccaaacggtaaaggaaaaacaatctacaagaacggaaatacctacgaaggggaatatataaaaggtaaacgcgaggggaacgggacatatacgtttcacgatggagaaaagtatgtggggcaatggttccaggatcagcaacacggcagcggaacctattattttatgaataataaccggtatgaaggtatgtggtttgccgactatcagcagggtgaaggcactatgtattattataacggagatgtttatataggtaactggtttcaggacaaacgtagcggaaagggtacttatacctggaaagcaggagccaaatatgagggcgaatggaaagaagacaagaaaaacggacagggcgttatggtatggcccgaccagtcaaaatatgaaggtgagtggaaagatgacgcacgtgacggaaaggggacattttactatgtcaacggtgacaagtatgtgggcgactggaaggatgacgtgcagcatggtaaaggtatttattactttaatagcggtgaccgttacgaaggtgactacgtaaacggtgaacgtaccgggcagggaatttatgtacacaagaatggcgacaagtatgtagggcagttcaagaacggcgagcagcatgggaccggaacctttacatgggccaacggtgctgtgtatgaagggcagtgggtgaataaccagcgcagcggtaaaggacactatatctgggcgaacggcgatgactatgaaggtgaatggaaaaacaacatggccgacggtgaaggcactttgcgcacggctgacggaaccaaatataagggccatttcgtaaaaggaaaggaagacggcaaaggcgtgcttgaagataagaacggagtacgctatgacggatttttcaaacaagggaagaaacacggcgcttttgtggagactgacaagaatggaaatgtaatccgtaaaggtgtttataagtttggaacgctggatgcggaacaaaaataagaatataatgttggatttagagaagataacgttgaaagtacgtgaaatagcactccgggcgggtgcttttcttcgtaaagagcgtagcggttttgaccgtagcaaggtagagaagaaaaatgctcacgactatgtatcgtatgtagataaagaatcggaacgccgtattgtggctcaacttcgggaattgcttcccgaagcaggattcattgccgaagaaggttcgggcagcctgactacggaaaactattgctggctggtagacccgctggacggaaccaccaattttatccataataatgctccttattgtgtgagtatcgcccttcgtagtaaagaagaactgctggttggagtggtgtatgaagtatgccgcgatgaactttactggacttataaaggagcgccttcttatctgaacaacaaagaaatacatgtatcagatgtttctgatatggacgaagcgtttgtggcgttaggctttccatacgattcgcaaaagtataagccattggcggagcatattgtgcacgagttgtatggaaatgtgggaggtatgcgcctgcaaggagcagctgcggcagaactttgctatgtagctgccggtcgctttgaagcccgtatagaaggactgctgggaccgtgggatattgcggccggttcgataatcttgatgaatgccggtggaaaagtgacagattacagcggagggggagatttctattccggtcatgaagtgttggctaccaatggaaagctgcatgatgggtttctcaaggtcttgggaaaaaaataaatacttcgcttttttctagttcgttacaaatatattttgtaagtttgtcaagtgaacacatgaacataatgtaacatggatgtatctgttatctttcaatttttaaaaaacctggccacaaacaataatcgggagtggtttcaggagcataaggatgaatatctgaaagctcaaaaagagtttgaggaattactgacagcaatcatcgcccgtatttcgttgtttgacgaaagtattgtcggtattcaagctaaggactgtacataccgaatttatcgtgacacgcgtttttctagtgataagactccttataaaatacacttgggcggctatatcaacgcccgtggaaagaaatcagaacattgtggatattatgttcatatagagcatgataactgtatgcttgctggtggaagctggtgtctggaatctaaagtgctgaaagctgtccgccagtccatttatgacaacatagatgaatacagagaaattgtggaagatcctgcgttcaagcaatactttcctgttatcggagaaaatcacttaaaaacggctcctaaaggatttccgaaagattttgaatatattgattatttaaaatgtaaggattatacctgtgcttatatggtgcctgatgcgtttttccttgcccctgacctgttggacaaagtagaggatgttttcaagcaactgaagcgttttgctgattttacaaatttcacaatagacgactttgaatgataaaagcaatattttaaccattaaaatgaaataattatggtagtagacagattagaaaacttagaaaagtacgcttcattgaatcctttgttcgctaaagcaatggaatatctgaaggctacagacttgaacgctcaggaattaggaaaagtaaaattacagggtgatgatctggtagtaaacttttctcagaccaagcctaaaactaaagaagaagcaaaattagaaactcataatcagtttattgatatacagattcctctgtcaggggtggaagtgatgggttatacagcccgtgaagatcttcccgaagcagactatgatgcagataaggatatctcgttctatccgggacttgccgaaagctatattcctgtaaagccgggaatgtttgccatcttttttccacaggatgctcatgctccgggagtgtctcctgacggcgtgaaaaaagtgatcgttaaagttttggtttgaaagagaataactaacaagtaatcatattatggaaaataccactcctaaattaggcataatagaaagtgatccttggctggaaccgtattcggcagcgattgaaggacgccatcagcatgcattagacaaagaattggaactgaccggaggcaaaggaactttgtcggactttgccaccggatatttatatttcggcttgcatcgtaccagaagagggtgggtgttccgtgaatgggctccgaatgcgaaggaaatttatcttatcggagatttcaacgactggaaagagcatggcgattataggatgtaccatgtaaagaactctcctggcgtatgggaggtggaattacaaagcggtgctataaagcatggtgatttgtataaactgaaagtccgttggaatggcggtgaaggagaacgtataccagcatgggctaaccgtgtggtacaggatgatcagacaaagatattcagcgcacaggtttgggagccggagaatccttaccggtttagaaagaaggtgttccgtgcaaagactgatcctttgatgatttatgaatgtcatatcggtatggctcaggaagaagaaagggtaggcacttataatgagttccgtgagaaaatattgccgcgtatagcggaagccggatataattgtattcagattatggctattcaggagcatccttattatgggagtttcgggtatcatgtttccagctttttcgctccgtcatcccgtttcggtacaccggatgaattgaaggaattgattgatacggcgcatagaatgggaattgccgtcattatggatattgttcactctcatgccgtgaagaatgaagtggagggacttggcaattttgccggtgatcctaatcaatacttctatccgggcggccggcgtgaacatccggcatgggattccttatgctttgattatggtaagaatgaagtgattcatttcttgctgtccaattgtaagtattggatggatgagttccgttttgacggttttcgttttgacggtgtgacatctatgttgtattatagccacggcttgggagaggctttctgtaattatggggattactttaacgggaatcaggatgataatgcgatttgttatttgacattggccaacaagttgattcatcaggtaaattccaaagcgattaccattgcggaagaagtttcgggtatgcccgggttggcagcaccgattcaaaatggtggatatgggtttgattaccgtatggccatgaatattccggattattggattaaaacaatcaaggagaagattgatgaagactggaaaccgagcagcatgttctgggaagtgaccaacagacgtaaggacgagaagactatttcgtatgccgaaagccatgaccaggcattggtgggcgataagactattattttccgtctgatagatgctgatatgtattggcatttccagaaaggggatgaaaattatacagtgcatcgtggcatcgcattgcataagatgattcgtttgcttactgcctctaccatcaatggaggatatttgaactttatgggtaatgaattcgggcatcccgaatggattgattttccacgtgaaggtaacggatggtcgcataaatatgcccgtcgtcagtggggactttttgataataagaacctgtgttaccattacttgggcgattttgattcagctatggtccacctcattgaaagtgtgaaaaatattcaggatactccagtgattgaggtatggcataacgatggtgaccaagtgttggcttaccggcgtaagaatttgatttttgtatttaatttcaatcctaccaagtcatttacagactatggtttcctagtgcctgtcggggcgtatgatgtggtactgaatacggatgcgacagctttcggaggcaatggtctggctgatgacagtatacgtcatttcactaatttcgaccctctttataagaaggataaaaaggaatggctgaaactgtatctgcctgcccgttcggctgtggtattgaaaaaagtgaaagagtaatttatgagcagcaacaacagcttatcctataaaagagccgcccgcatcctcacggttgcgtgcggtcttcttttctctatttttagtattgtctatctttttgtgcttcagaaagatgtcgtaggtgcattgcattattcattgtcacaaggaaagacacattattctccgttggcaggagctatcatcattacagtggttttattggtattccgttggggaatcaatggattgatgggattaaaaggccctgtgcgaacactttcttatttcccgtcttgtctgttgctgggagtgctgacggatgtggaccggactattttccacggaggaaacatagaggataaatggttttggctgctgccgttgcttttgcttatatatataggtgttgtctatactttacggcgtgtgtttcgttcctggttgaatcaagagggttctatattgggcttaataaactctaacttagcaattttgacacttttatgcctgatgacggtaggtataggaaatacgaatgtgaattttcatcatgaactggctgtggagcaggctatccgtaatcatcattatgaagctgcacggatgataggagcaaagtctttggaaacaacccgtacattgacagtgcttagagcctatgctatgtctttggaaggtaccatgggggagcatttgtttgaataccctcaatattatggtgcggaagggcttttgtttgcgcctcattctcaggaaactttgcgcttgaatgccgatagcttgtatgctcatcttggtgtaagaccacatgttgcagaagagacagtagactttttggcccgtatctgtcgtgatgaaataggtagacataccgctttgaattattatatgagtgcattgctgctggataagaaattggataaatttgtatcggcggttgatatgtattgtttcgagcaagatacattgccgcgttattatcgtgaggcattggtgctttataaacggactcatcctggatatggaagagaagttaaagacacgctgatggtgcggcgtttggatgagtttcttaaccgtcagaaggaattttcatcaccagtggaagagaaaaaccgtatgcggcgggaatatggtgatacctattggtggtattatcgttatcaataagttatttttatatttttcgactctatatttttgctaaatcattagtactttcccatgcttttttactaattttgcaaactcttaaaaaggaaaaacaaaaataacgatatagcatggcagtagaattgaaagaacttaccaaaagaagcgagaattattctcagtggtataatgacttggtggtgaaggccgatttggctgaacaatcacctgtgcgtggatgtatggttatcaagccttacggatacgccatttgggagaaaatgcagcgtcagttggacgatatgtttaaggaaaccggtcacgtaaatgcctatttcccgttgcttatcccgaaatcttaccttagccgtgaagctgagcacgtagaaggatttgccaaagagtgtgctgtagttactcactatcgtctgaagaatgcagaggacggttcgggtgttatcgtagatccggctgccaaactggaagaagaattgattatccgccctacatctgaaacaatcatttggagtacatataagaactggattaattcctatcgtgacctgcctatcttgtgcaaccaatgggcaaatgttatgcggtgggagatgcgtacccgattgttcctgcgtactgcggagttcttgtggcaggaaggtcatacggctcatgcgacccgcgaggaagcagaagcggaagcacagaaaatgttgcatgtgtatggtgacttcgccgagaagtatatggctgtcccggtaatcaaaggggtaaaatcggctaatgaacgtttcgcgggtgcgttggatacttacaccatcgaaggtttgatgcaggatggaaaggcattgcaatgtggtacttctcacttcttgggacagaattttgcgaaagcgttcaatgtacagtttgttgacaaaaacaataagctggattatgtttgggctacttcctggggagtatctacccgtttgatgggtgcattgataatgactcactctgatgataacggattggtgttgccaccacatttggctcctattcaggtagttatcgttcctatttataagaatgatgaaatgctgaagaagattgatgcaaaagtagaaggcattgtcaacaagttgaaagcaatgggtatttctgtgaaatatgataatgcagacaataagcgtccgggattcaagtttgcagattacgaactgaaaggtgtgcctgttcgcttggtaatgggtggccgtgatcttgaaaacaatacaatggaagtgatgcgtcgtgatacattggaaaaagaaactcgttcttgcgacggaatcgaagaatatgtacaacaattgttggaggatattcagaacaatatttatcagaaggcattgaactatcgtaacgaacatatcgtgaaagtggattcatacgatgatttcaaggaacagatagagaaaggtggctttattctggctcattgggatggaaccccggaaacggaagaccggattaaagaggataccaaggcaacaattcgttgtcttccttttgatgctgatgaagagagcctgactccgggcaagtgtatggtaaccggaaaaccatctgctcgccgtgttctctttgcgagagcatattaaacttcgacacatttattttatttttaatacattatgtggagtcggcagcagtgaatgctcccgactctttttgttttaatgtgatgattaatatagaaaatatatctataagttttggtaatctgactcttttcagaggacttgacctgcaagttcattacggagaaagtgtatgcatttgtggtggttccggcagtggaaaatcttcattgctgaaagctgttttgggctttgttcctttaagtgaagggacaataagggtggacggcacactgctggcacctaagacggcggatcatatccgaaagaaaatagcatggattccccaggagttggctcttccttcggaatgggtcagtgaaatggtgcggatgccttttgaactgaaggcaaatcgtgaggcgggattcagcaaagagcggctgatggattatttcgtatcattaggattggaagagaaactttatgataaacgggtaaatgaagtgtcgggtggtcagcgtcagcgtatcatgttggcagtgacagccttgcttgacaaacctttactggtagtggacgaaccgacttcggcacttgatccggaatcgtgtttacgggtgattaacttctttaaatccttatgcagtaaaggaatgactatattgtctgtttcgcatgacaaacagtttgctgccggatgcgacaaggtatttactttataatctgactgatgggaacaattgatatagactatggcagtttgggagtaggattgctgctgatgcttattccggtttattttttatggcgtttcaagacgggcttgcttaaaccggttctgataggcacagtacgtatgattatacagttgtttttgattggggcttatcttcgttttctgtttgaatggaacaatccgtttattaattttttgtgggtgatcatcatggttggggtggctgctgaaacggctttgacgcgtacgcggttaaaacgcggaattttgatgattcctatttctatcggtttttttgtaacagtggtgcttgtcggactttatttccttggctttgtattaaagttggataacatcttcagtgcccagtattttattccggtttttggtataatcatggggaatatgttgggagtgaatgtgataggattaaatacttactatgccggattgcgtagggaacagcaactttattattttctgttggggaatggcgctacccgtaatgaggcgatagctccatttgtgcgtcaggctcttattaaagcgttcagtccgggcattgccaatatggcagtaacagggcttgttgcattgccgggaactatgattgggcagatattgggaggaagttcgccacatgtggctatcaaatatcagattatgattgtagttataactgtggtggcatctatgctttcactaatgatgaccatttttctggcttcacggaaatcattcgacagttatggccggttgttacgagttcataaggataccaaacggaagtagggtctttccttgctttgtatacattatatatttctttcaataaaatagaaaaacatgaatgagcaaatttggaaatatatagcagaattatcaactcccggtttctttgtcactgcggatataatgtatgaaggagaggaatttcctgtagatattaaagcatttatcattgataaactagctttgatagaaacaggaatatcagcccgcaaatttacgtttcattcgggcggatggcgtattcatcttactttttttccgacagaccgtgttgttgacgaacgttatgctttgaaaaataaaatgataaagtggggaaagtataaaaaatagcttggttgctttttaaattcaaatggattgattatctttgcaatcaaattttcgcgaacgaatgaaaattaaggaaatagtaagtgcccttgaaaggttcgcgcctctgcctttgcaagacggatttgataatgccggattgcaagttggactgacagaagcggaagcaacaggggctttgttgtgtctggacgttactgaagctgttgtggatgaagctgtcatgttgggatacaacctgattatatcacatcatccacttatatttaaaggttataaatctattatgggtcgggattacattgaacggtgtgttttgaaagccattaaaaatgatattgtcatttattcggcacataccaatctggataatgcacccggaggtgtcaattataaaatagctgaaaagataggtctcagaaatgtacgcatattagacccgaaagaagaatatttattgaagcttgtaacttttgtgccggatgcacaggctgatagagtgagaaaagctttatttgaagccggttgtggttgcataggtaattatgattcatgcagctataatttggaaggtgaggggactttccgtgcgcagaaaggagccagtccgttctgtggagaaataggcgaattgcataaggagtccgaggtgcgtatagaaacgattcttccggcttttaaaaaggctatggcggtaaaagcattattggcaacacatccttatgaagaaccggtttttgatttttatccgttgaaaaatacttggacacaagtaggttcgggggtgatcggagaattggaagaacctgaaaccgaactggatttcttgaaacgcatcaagaagacgttcgaagtgggctgtctgcgacatactcgtttatctggtcgtttgatacagaaagtagcgttatgcggtggtgctggagcatttttattgcctaaagcggtaagtgccgatgctgatgtatttatcacgggtgaagtgaaatatcatgattatttcaattacgagaataatattctggtagctgaagtaggtcattatgagagtgagcagtatacaaaagaaatattttattcaatcatgcaggagatgtttccggaactggaagtccagataacccgggtaaatacaaatcctattaaatatttgtaagaaaaaactatggctagagaagcaaagaaagacccgagcgaattaacagtggaagaaaagctgaaggctttgtatcagttgcagaccatgttgtctgaaatcgataagattaagaccctgagaggggaacttcctcttgaagttcaagaccttgaagatgaggtcgccggtttgagtactcgtatcgagaaaattaaagctgatatcgaggaactgaaatcaaacattgcgactaagaaaattgaaattgagacagctaagacttctgttgaaaaatataaagctcagcaggataatgtgcgtaataatcgcgaatatgatgtgttgacaaaggaaattgaattccagtcattggaaatcgagctttgcgagaaacgcataaaggaatatattgcagcggaaaaagcaaagagcgaggagatagagcacagtaatcaagacttggatgaaagaaagaaggacttggaagcgaagaaatccgaattggaagaaattgtttctgaaaccaagcaggaagaagaaaagctgagagagaaagcaaaagtattggaaacaactatcgaaccgcgtctgttgcaggcgtttaaacgtatccgtaaaaattctcgaaatggattgggaattgtgtatgttcagcgtgatgcatgtggtggttgttttaacaagattccgccccagaaacagcttgatatccgtatgcgtaagaaaattatcgtatgtgaatattgtggtcgtatcatgattgaccctgaattggcaggtgtgattgctgaacagcacttggaaactgtcaagagataatatcgcctgaagcagtatctttttctttgtggaaaaagaatttcatcacattctgagcaagatcttgtaaggagatgttgcttagaatgttttttatatatctacagttctgaatagtggggaatctctggtagaaaaagatatgtttttgtattgtaatcaatatggcagcagtaatgattcaatccgttgctgacaatcagataatcaactttcagaaccatgttatacctggttatctgatcaaatactgtttgtgtgatttctatatgtggagctttgtactccacaatcagtttggcacttagatctttgttgtagagcacagtatcacaacgtttttttgttccgtttaagtctagttgtatttcgttggccagtaatcccttcggatatcctttataatccgtcaggtaatgaacaaaatgttgtcttacccattcttccggagtaagggcgacatatctcttgcggagcatatcgaaaataacattttttccatttcgctccgcgattttaatttcgtaggatggtaagtttaatgataacatttagtaaatttgcataagtgtaactcggtaataaccgatgcaaaaatacaaaagattatgaaaacaaaagaggaaattgtagcaaactggcttccccgctacacaaaaagaagcttgaatgatttcggagaatacatccttctgaccaatttcaataaatatgtggaactttttgccgacaaatttaatgtgccggtactaggacgtgatgccaatatgacttcggcacatgcggaaggaatcactattattaattttggcatgggaagtcccaatgctgctatcattatggatttgctaggggccatccagcctaaagcatgtttgtttttaggtaaatgtgggggcatagataggaaaaataagttgggagatctgattctgcccattgcagctattcgtggagaaggaacatccaatgattattatccgcctgaggtacctgcgttacctgcatttatgttgcagcgtgccgtctcgtcggctatccgcgaccatgcccgcgattattggaccggaacggtatatactaccaaccgccgtatatgggagcatgatgaggggtttaaaaagtatctccttaaaacgcgtgccatgtgtgtggatatggaaacggctacgctgtttactaccggtttttacaatcatattcctactggagcattacttctggtatccgaccagccgatgattcctgaaggggtgaagacggagaaaagcgacagtattgtaacgcagcaatatgtagaggagcatgtggagattggtattgcttcattacaaatgattattgaggaaaagaaaacagtcaagcacttaaaatttgactggtaattttactgtgtatggcaaaagaaacaacatacgaagaaatagcccgtgaactgaaaaaccgtatctataagcctgtttattatctaatgggtgaagaatcttattatatagatcggatatctgagtatatagcacaaacggtgttaaatgaaaatgaaaaagaattcaatcagactattgtctatggggctgatacagatatcgcgactgttatcaatgcagccaagcgttatcccatgatgtccaaatatcaagttgtaatagtaaaagaagctcagaatataaagaatattgaagagcttgcttattatctccagaaacctttggattctacaattctggtgttatgccataaacatggtacattggatagaagaaaaaaattggcagctgaaatagagaaagtaggtgtccttttcgaatcgaaaaagattaaggatgctcagcttcctggctttatatcttcttacttgaaacgtcgttcagtagaaatagagcctaaggcttcagaaatgatggcggaatttgttggagcagatttaagccgtatggccggagagttggaaaaattaattatcacgcttccaagagagcaaaagcggattactcctgaacaaatagaacgtaacattggcataagtaaggattataataattttgaacttaggaatgctttggtggcaaaggatgttttcaaggctaatcagataataaaatattttgaggagaaccccaaaacaaatcctttgcaaatgaccttgtctgtgttattcaatttcttctctaatttgatgcttgcatattatgctcctgataagtcagagcagggtatagccaatcagctggggcttaaatcaccatggcaatctaaagactatatggctgctatgagaaaatatagcggagtaaaggtgatgcaaattattggtgagattcgttactgtgatgcaaaatcaaaaggagtgggtaatccatctttggaggatggagatttgctgcgagaacttgtatacaaaattcttcattaactaacgaggtcaaacaagattccgctatcccgatgcttttgtttttttaagtgtcgggattctttttatcctttctcttagcagaaatcctgttgatgactcaattgagaataatattttacattcatacttttattattacctcatttaatgctacagttatgtttttgttctctatttttctagatgatgagagatggatgatgagaaaaatagtattaacttgcttattcctagattgatagaccatttttcgccttcttagaatcgcgtattttaaagggaatgtctgtttgtacatgaataatggcagtatttagccttttcggagtaaaatgaataagaagaatggaaagaatgcagatgaagcaagtaaacagcgacaatttattttttgcaaattcatacgttagtttaaattttgaatccatactttgtcctcttatcgtgcattctatgattctcattatctatgaatcccataaagcgaaaatgggctaaaacttggatggggagttcttgtctttaccatgaaaaatacattgatacttgtaaaataggaaaacaaaatattcataggatcaagctggagcgtaaaacagagaaaattcacttttagaaataattataatttaattttgtaatcttacatctgtaaactttcctaatataggagatattataagctttgcaggtttaacaatgtaaataatacaaatataaacaaggtagtagtcaagagtgaagattacatatataaatgtatatgaataattatttatctcttattttattacgataatatgcttgaaaccagtgttttatatcttgtcgataaagtggttaataacttgtatgcattttatttgcttatataatcatatttatttgtaaatatatcatttttgttgtgtatatattatagataatcagtattttatatagtcatgcataaagtgataattatagtatttttaggagcggtttacgtgtgtaaatcttaatttatttccaataatatactcatactttacttttgtaagatatacatttccatattgtaaatttgcatttatgaattatattaattacttttgtatctgtaaattttgccttatacttttgtaaatgaaggaaagaatcgctcaaataatccagaaagaagatatgactgcagctcaatttgcagagaagattggaatttcaccttcctctctttcccatattcttagtggtaggaataatcctagcttggaagtcgtcatgaaaatacacaaagcgtgtgactatatcagtttagactggttactctatggtgaaggacaaatggaaacggatgttgattcagacaataacattcattatacgccttctttgtttgatgagaattcattatttacgcccgaacgtccagtttctccggaatatcgcaaggaaaatgaggttaaaacaccactttattctcctaaagagattgtgcgtgaggaaattaagtatgtggaaatacctgccaaaaaaatcactgaaataagaatattctttgataatgggacttatgaaacgttcaagcctgaaaattagggtgggaatccactaaaatgccggttagcagaataagatttgggtaaattcgtgtatctttgcatagaaaatgaatttacccaattttatttcatgaaaaaatatattttagaccttgtggttacacagaacataaaattgcatgccaattatgttctgataaaattgactcatgccaacccattgcccgagatgctgccgggtcagtttgctgagatacgtattgacggttccaatacaacttttctccgccgtcctatttctattaattatgtggataaaacaaccaatgaagtttggttcctggtgcaattagttggcgatggcactcgcaaactagccactgtgaaacaaggagatattgttaatgtggtgatgcctctcggcaatggatttacaatgccccggaatgtgacaaaggtaaagccgctactggttggcggtggtgtgggtaccgccccgatgttgatgctcggtgctgagttagtgaaaatgggatgtacgcctgctttcctgctaggcgcacgttcatccaaagatctgttgcagctggagtattttgagaaattaggtaaggtgtatacaacaactgaagatggaagtatgggcgagaaaggctatgtgacacagcatagcatcttgcatacagatcggtttgatatgatatacacctgtggtccaaaacccatgatgatttcggtagctaaatacgccaaagttcatggaatagaatgtgaggtttcactggaaaataggatggcttgtggtgtcggtgcatgcttatgctgtgtggagaacacggacgaagggcatttgtgtgtttgtaaagagggtcctgtatttaatataaagaaactattatggcagatttaagtgtaaatatcggcgatttaaagctttgtaacccggttatgacagcatcgggtacctttggatacggaaaagaatttgaggactttgtagacctcgaaaaaattggtggcatcattgtaaaagggactacccttcatcatcgtgagggtaatccttacccacgtatggcagagacccctatggggatgcttaatgcggtagggttacagaataaaggggtagattattttgttgaacatatctatccacagataagggatatccatactaatatgatcgttaatgtatccggatctgctgtagaggattatgtgaagactgccgaaatcatcaatgatctggataatattcccgctatagaattgaatatctcatgccctaatgtaaagcagggcggtatggccttcggggtttccgcatgcgggtgttccgaggttgtaaaagctgtacgtaatgtgtataaaaagacgctgatcgtaaaattatctcccaatgtgacagacatcacagaaatagcacgtgcggccgaggcttccggtgcggacagtgtatctctgatcaataccctgctggggatggctgtcgatgctgaaaagcgtcggcctgtactttccactattaccggcggcatgagtggtgcagctgtgaaaccaatcgcattgcgtatggtatggcaagtcgctaaagcagtaaatattcctgtcattggactaggggggatcatgggctggaaggatgctgtggagtttatgttggcaggtgccaccgcaatacagataggtactgccaacttcatagacccagctattactgtcaaagtttcagaaggaataaatgactatttggaacgtcatggatatacatctgtaaaagatataataggcgctttagaaatctgaaaattttatcttttaaattatagccctgcgagagtgtagatgaataaattgaagcatttcttgcagggccttttttataaccttctctagatagaacgagtataaaaatggttgttgttacaacttattgcatgggtataaaatgataacttcaattattttttttcgatgaaatggcttgtttttgaaaaaatggagtagaaaaacacttgaaaaagctttatcaatatataaggaaaaggaagatggacttaggttatattaaagagagaacatcttttcaggtatgatataaacaaaagcaaagaggtaaaagccatgttcatcataaggcttttatctctttattttttatatatattttttattttagcaaatcgggtcttagccgctgtgttctttctaatgactgctgaagctcccattctttaatctttgcctcgtgtccggataacaacacatcgggaacttgccatcctttgtattctgcaggacgggtatatacaggagctgctaacagattatcttgaaaagaatcggacaatgccgattgttcgtcagaaatgaccccgggaataatacgaactacggcatcggcgataacggcggcagccaactccccacctgtcaaaacatagtcaccgatactgatttctttcgtaatgaaatgttcacgtattctatagtctatacccttaaaatgaccacatagaataattaaattctttgcgagtgaaagtgagttggccatcggctggttaaactgttctccatctggagatgtaaatataatttcatcgtactcgcgttctgctttcaaagctgagatgcatcggtctattggttcaatcttcatcaccataccggcaaatccaccgaagggataatcatctactttgcgataacggtcgtatgcataatcgcgtaaattatgtatatgtatttctgcaattccttttttctgcgcacggctcatgatagagcagttgaagaagctttccagcatctcgggtaaaacggtaatgatgtctattctcatattcggttattttttgcaaaagtagcaaattcctctttgccggaaggtgtttttcattcaaaaaatagctatttttgcgggaaaactacctttatatatatgacagaaatagaaagaatagaccaattgcgcgaggagcttcatcgacataactataattattatgtattgaatgcgcctgagattacagaccaggagtttgacaagctgatgcgtgaacttcaggatctggaagaaaaacatccggaacatagagatgagaactcgcccagtatgcgtgtgggaagtgatataaacaaaaacttcatgcaggtggtacataaatatcccatgctttcattgactaacacctattcggaaacggaagtaaccgagttttatgacagggtaaagaagtccttgaacgaagattttgagatttgttgtgaaatgaaatacgatggtacttctatttcgctgacttacgagaacgggaaattgttgcgtgctgtgacgcgtggtgatggcgtgcaaggagatgatgtgacaggcaatgtgaagaccatccgcagtatccctttggtgttgcatggaaaggggtatcctgaagcatttgaaattcgtggggagattttgatgccttgggtggtgtttgaggaattgaacaaagaacgagaagcccgcgaagaaccgttgttcgctaatccccgcaacgcagcttcgggaacattgaagttgcagaattctgccattgtggcatcccgcaagctggatgcatacctttattatttgcttggagataatttgccgtgcgacggtcattatgaaaatttgaaagaagcggagaaatggggatttaaaatttctgatcttactcgcaaatgcaaaacattgcaggaagtatttgatttcatcaaatactgggatgtggagcgtaagaatctgcctgtagctacggacggaatagtactgaaagtgaattctttgcgacagcagcgtaatttgggttttacggcaaaatcaccccgatgggccattgcatacaagtttcaggccgaacaggcacttacccgtttgaacaaggtgacctatcaagtgggaagaacaggtgctgtgactccggtggccaatctggatcccgtacagctatccggaaccgtggtaaagcgtgcttcgctccataatgcagacatcatagaagggctggatttgcatatcggcgatatggtttatgtagaaaaagggggcgagattattccaaaaattgtaggtgtggacaagaacgcccgtattatgataggtgataaagtaaagtttattacttattgccccgagtgtggcagtaaattggtgcgctatgaaggtgaagctgcttattattgtaccaatgatgccgcttgccccccacagatcaagggaaaaatagaacattttatcagccgtagggctatggatattgatggactcggtccggaaacggtagatcagttttaccaggaaggattgatacgtgatgttgccgatctgtatactttaaaaacatcggatatcatcaacctggaacgtatgggagaaaaatccgctgagaatataataaaaggtatagagcagtccaaagaagtgccgtttgaaagggtgctctttgcattgggtatccgttttgtgggtgaaactgtggcgaagaaggtggcgaaatcctttaagtcgatggatgctttggcagacgcgagtttagatgatttgattcatgtcgatgaaatcggagaaaaaatagcacagagtatcttgttgtactttgctaatccgaagaatcgtgacattatagagcgtcttcgtgtggcgggtgtgagattggaagctgatgaggaggatacttcgggacacactgacaaattggcagggaaatctattgtgattagtggggttttcgcccatcattcgcgtgacgaatataaggagttaattgaaaagcatggtggtaagaatgtgggaagtatttcgtccaagaccagctttgttttggcgggtgacaatatgggacccagtaaactggagcaagcgcagaaactgggtgtgaccattgtgagcgaagaagagtttctgcaaatgatagagtgactttttagcgagtataaactaaaaatagtgtgatttttatcgctaaaagagaaaatattcgtacttttgtaggctattaaataagaatttataattcatttatgatacagacaagattaaaaggcatgggagtagcgttgattactcctttcaaggaagatgacagcgttgattatgatgcgttacttcgtctggttgattaccagcttcaaaatggaacagattttttgtgcgtgttgggaaccacggctgaaaccccgactttgactaaagaagaaaaagacaagataaaatgtttgataatcgaaagagtgaatggacgtatccctattctgctgggagttagcagcaactgtacccgtgctgttgtggaaacgctgaaaaatgatgatatgacaggagttgatgccgtacttgttgctgtaccttattataacaaaccttcccaggaaggtatttaccaacactataaagcgattgctgaagcgacggatcttcctgtggttctttataatgtaccgggacgtaccggtgtgaacatgactgctgagaccaccttgcgtctggcacgcgatttcaagaatattatcgctatcaaggaggcatcgggtaatattactcagatggatgatatcatcaagaataaaccggctaattttgatgtgatttcgggtgatgatggtattacatttcctttgattactttgggtgctgtaggggttatctcggttatcggtaatgcatttccgcgtgaattcagtcgtatgactcgtttggcattacagggtgattttgcaaatgcattgactattcatcataggtttacggaattattcagcctgttgttcgtagatggtaatcctgccggggtgaaggctatgttgaatgtaatggggctgattgaaaataaattacgtttgccgcttgtaccgactcgtatcacaacatttgaaaagatgcgtgctattttggatgaattgaaaattaaatgctgataaaggaatttttttaattagataagactggtgtttcgtcattaaaaacaccagtcttttttttatgcctgtctgttcgttctttgatatattatacctgtaagattctatatctttcacgcgtaacattactaatctttcacctgatacattagtaacgtgttacccgacacgttactaacctgtcggtctgtatgttagtaacctttgaaacgccttgttttttaaaaaagaacaagcgcttgtttaaagatgaactgttcttttcaggtgtgtgagaagttgtgttggtcgtcattgtttcgttggagaaggtgtaggcgtgattgaggataatttcaatgcttccaagaagcgttcccaagttcttctaaaccataatgcttcttttttatatgctgcaaagatataagaacggaaaaatggtagacctgtagaagcgcggaggtgcttaacaggggattttcccccaagaattacaactgagccatttaaatttaaaaaaagagagaaaatacaagaaaagaccatcagaaaagatggccttctttgtgatcgcgacaggattcaaacctgtaaccggctgatccgtagtcagctactctattcagttgagctacgcgnnnnnnnnnncaaacctgtaaccggctgatccgtagtcagctactctattcagttgagctacgcggccattgcaaaactaatcgaacttcttttggtagtgaccgcgacaggattcaaacctgtaaccggctgatccgtagtcagctactctattcagttgagctacgcggccattatttattgttcttttgttttaacgggtgcaaagatacggactttttttgaaaatgcaagcgttttactaaaacttttttctaaaaattattcgatgaaacgggagttaaacaactgccagcccagtgttaaacctacattccaatcgttagacggtgaactatagtggtttacataagcactgatagaaccgaacgataattgaaaaactaatgagatttctccaagatattcgaattttgtgaaagctttcccgtaatatgcttgtccatattcatctttcttgataggaaagatgggtacaaatccataaaattctccgcgtaattgaaaagactcgcttaactggtagatgggcatggcgccgactccggcatattgattagcacggaaagcctcattataggttactttgctatgggctgtcggagtgaattctcctgcctgcattaatgtagccgtataattattggagaaatttcgggatgagtaatacgcctctagatacgctcccaaggtaaacttaggacttaccttatggtatgtttcgttctgatatgaaacttgaagccaggattgtacctttttataaggttccggtgtgtctttagtcactttggatgcacctgatctgaaatgttctgtgccggtgaaaatttgtgcagccattttttcacgacttccttgtgtggcaaactggcgggcattcaaggtgcttccttccaatacgatagagcctccgaagatagaataagtgcttttatcatgttttgtctcgctgaagtcgatgatattggtttggaagtacctgtcttccatacgggctatacctacaccgaattcagctttcttacggcttagaaacggtaatgacaccttcaattttacaaactcttctcttttcttgttgaaagccggattgtctttattggaaaagaatttggcttctttgaaataatcgaaggtagagatcgaggctatgaatttataagatgtaggcagcttggttggaaaatcaattcgtgctgcaagttgcacattattgtagacccgacctaactgtccgtcaaaattaaattcttttgaataatagttcaagttttgataggaagcaccaaaatagacttgattggagccactggaagacacgtttccaccgacacgaacggagagattggcctccattttgacttggaggttcaagtcgtaggtttggtctttctcattataaacggcatgaggaatgatttcggatataatattatcggacaacaaacggaaatatgctcgtttgatatcctccatagtgaaaacatcgaagtcgttttcatggaactctttttgtatatattgcttttgtcgttcgttggcaccagttatatttactcttttgaaacggaaatccggtaaattgctcttataggccagtcgtttaactttcacttgttcgggggtgattcttcgatgaattcggctttttatggagtccatcatttctatggcacgtttataaccaatgtcatgcaactcgtcaaagcgctggaagtccattaaattgacatcatcatatttaaaagtcatgaggatgccgagggaatcgggtaaagagtaatctgtcttttgcataatcatattttccagttgccccataatgtcaccttccttgggtttgcccggattggcggatacggcacttcctataatgatatccggatggaaggtgtcacgcattacattcactggaaaattattgtaaatgccaccgtcgtatgccagtatcgagtctatttcgataggcttgaacatggcaggaaaactcatggaggcacgtacggcatctcccagatctccttttttcaatatcagtggtcttttattgtacacatccgaagctatacagcggaagggaatatacaggctgtcaaaattggccttgcttgcagctgttgcctgaccgaataattgcagaaatacaatattcatctgaatgggatctacaatgctggtaggcaaaaactgaggtttgacattcttcagcgagtctttcagggagatacggatgttgataaattcgggtgttggaggatttttcttgaaataatagatgtatttctcttccacattacctgaataccagcgtttgaagtcatcggatttgagtaaagcctccatttcatcgggagaatagcccatagcataaagtgaaccgacaatggctcccatggatgtgcctgcaatataatctatggggataccgttttcttctaatgcgcggataatgccgatatgggttaggcctttggcacctcctccgctcagtaccagtcccactttctgtgcatggatgggaggaagcagtaaaaagagaagaaaaagtatatatagataatgtttcatggatgtcgaatctttgtatgtgttgctccaaatatagaaagaaatcttcgtttccaatcgttttttagaataaaaaagcgccggaaatgaacttcccgacgcttttgatagcaaaatgtgatagatttgttaaatcagttcgatactgcgttttacaaagtttgtcaaagcttcgcctttcaacatattattttgtaacagagcaaggtcaatcaattggcggattactttgttaccacctgcgtattcacctaaaacagcttctttcttggtcttttcatcggccaactttttctcaacatcacttaattcatctttttctgcttgaggtatttcatcggcttttttaccttcctgtgctttgtgaagttcgtcgtgacgtttattcagactggtcatttcagtttcgataggttcaagagcagctttacaagagttgtccgcatcattcaaaacttgtttcaccagtttgtggtcgacattcagaaccaagttaaacatatccggcatttctccataaaaactcatacctgcctggatattggccatttctttcatacggcgcatatattcgctttgggtaatcatgataggagttcctgtctcgcctaaagattgtgtttctacattgaactccactttcttcatctgtggcaactgactgcggaatatggaagatagaatatcgcgttggccggcttccagactggcatctttgcgctcttctttagcaatcaggcggtcaattacatcactgtccacacgggtgaagcggctcttttcaaatttttgctcgagcatacttaccatagctacatccagctgaccatccattaacaatacgttgtagcctttgttcttggccgcatcaatgtagctgtattgttcgtctgcatgggtagcatacagataaatcaagttgccgtccttatctgtttgattatctttgatcaagctttggtattcttcataagtataatatttgtcatctgtgtctttcagcagagcaaatttattagccttttcgtagaactcttcttgggttaacatgccgtagttgatgaaaattttcaaatcatcccatttctcctcgaattctttgcggtcattcttaaaaatggcttgcaggcggtctgatactttcttagaaatataagtggagattttcttcacgttggaatcgctctgcaagtaagaacgggatacgttcaacgggatgtctggtgagtcaatcactccgtgtaacagggtcaggaagtctggaacaataccttctaccgagtcggtgacatagacctggttacagtaaagttggattttgtttttttgtaattcaatgttgctctttactttcggaaagtacagaatacctgtcagattgaacggataatccacattcagatggatccagaacaaaggttcgtctgccatgggatataattcccgatagaatttcttataatcttcgtctttcagttctaccggtttgcgtgtccataaaggataggtttcgttgattacattgtcttcatttgtttcaacctgctttccatctttccattctttctttttgccgaatgcaatggggataggaaggaagcggcaatatttagtcagcaatgaagaaatacgtgtttcttccagaaattctttgcagtcatcatctatataaaggataatatccgatccgcggctttctttttcaacattttcgatagtaaactcagggcttccgtcgcaagtccatttcacagcttgtgctccttcttggtgggattttgtgatgatttccacttttttggctaccatgaaggcagaatagaatcccagaccaaagtgtccgatgatggcattggcatcatctttatatttttcaaggaagtcgttagcgcctgaaaaagctatctgattgatatatttgtcgatctcttcggctgtaagtccgataccccggtcggaaatggtgatggtatcttttcctaaacttactttaatagtaagatctcccatctctcctttgaattcacctttagatgcaagggttttcagtttctgtgtggcatctactgcattagaaactaattcacggaggaatatttcatgatcactgtataagaactttttgatgatggggaaaatgttctcagtggttaccccaatatttcctttttgcatactatttatggttttaagttattatgttatatatacgtttgaatcgtctttttgttggatgatgggcaaaaaaaatgccagatacaatgatatctgacattttgtctgttattttttgaagaactttggactctttacttttccacagtcatgacaatgatgtctttttctttgtcatagcttaccttgatcgtgtcaccagccgccatttctgatccaagtatcagctcggagattccatcctccaaattgttttggatggcacgttttaatgggcgtgctccgaactgtacatcgtaacctttggtggctacaaactttttggcatcttcgtcgataacaagcttataaccaatgtgttccacacgactgtaaagaccattaagttcgatatcgataatccgagtcagtgcattcaggtcgagttggtcgaaagttattatttcgtccagacgattgatgaattcgggcgcaaaagacttattcaaagcttttgtaatcacgctgcgcgagtattctttgtcatctgtacggatttgggcggcaaatccgattccttttccgaattctttaagttggcgggttccaatattggatgtcatgataactatggtatttttaaagtctacagttctgccataactgtcagtcaaccgaccttcatccatcacttgcaacagtatgttgaatacatcgggatgcgctttttcaatttcatccaataaaacgatggagtagggtttacgtcttactttctccgtcagctgtccgccttcttcataacctacatatccaggaggtgctcctaccagacgggatacggtgaatttttccatatattcactcatgtcaatgcggataagtgcatctgccgaaccgaacattagtttcgctaactccttagccagatgagtcttgccgacacctgtcggacctagaaacatgaatgtaccaatcggtttattaggatctttcagacctacacggcttctttgaatagcttttaccagtgtggcgattgctttgtcttgaccgataactttagaaagcagatcgtctttcattcctaataatttcattccttcagcctgtgccattctttgcacaggtacgcctgacatcatggaaacgacttcggctatttgttcgtcatctaccgtttcccgattttccttcaggcttttttcccattcttccttcagagtatcaagctggttcgtatattctttctctttgtcacgataactggcggctagttcgaaattttgtaacctgacagcttcatttttaagagatttcatctcatcaatcagtttttcctgttcttcaatttctttgggagcagtgatattagtaagatgtacgcgcgaaccggcttcatctaaagcatctatcgctttatcagggaagttacggtctgtgatatattggtctgtcagttttacacaggcttcaagggccgcatctgtatagttcacattatgatgatcctcgtatttatctttgatatttttcaaaatctgaagtgtttcttctgcagttgttggttctacaataaccttttggaaccggcgttccaatgcaccgtctttttcaatattttggcggtattcgtccaatgtcgtcgctccgatgcattgaatctcacctctggccaatgcaggtttcaacatattggctgcatccattgagcctgctgcagaacctgctcccacaatagtgtggatttcatcgatgaaaagaatgatgttaggattcttcttcaactcgttcaaaatggaacgaatacgttcctcgaattgtccacgatatttagtgcctgcgacaacggcagtcatatcaagagctatcacgcgtttatcaaataaaatacgtgatactttcttttccacaatccgtaatgcaagtccctcaacaatggcagatttgccgactcccggttcgccaatcaaaatagggttgttcttcttgcggcggctcaatatttgtgccagtcgctctatttccttcacccggccaactacaggatccagttttccttcttcggcagctcttgtcatatctgtgccaaaattgtcgagtacaggagtgtcattagctggctttttttgtgccggacgtgcctgttgttgtgctgcatttgatttattgctacttggattctgacgtatatcttcgtcttcatcctcgtcctcactgaaccccagacctgcatggggatctggctgtaaagtgagtttaattttttcgtatgttacgccattgctttccaagacgtggaaagctgtattatccttgaccttcataattgctaataaaatatgttcggagtcagctgcaatgtttctcaataacttagcttccagaatacataactttaacactttggatgctttgtcattaaagctaatattctcgtcataggtggtgtcattttccacattgtttttcacaatggtctccaactgattttttatgtcctgtaagtttatttgtaaattaaataagatctcgatagcttttccttcaccttcacgtatcagtcccaacaacaagtgttcgggaccaatatagctattccgcagcctgttggcttcttccttgctatacatgatgatatcggacactctttgtgtaaattgattgttcataaatttatcgtcctcctaaagtatagtgtttatttcccagtgtgcaaagatacacataataacaatgcataccattgttttcttatttatattagcataacaaaatgtatgccaagctttgacagactaaatggattaaacaaaaataagggttatagcaaactattcacaaagtaaatgagaagtgggagtgataatcactatatactatagaataaggtatagggatactttttacttatataagtaaaaacatttaatggacttaacttttttatgggttttgtttcgtatgtcgtataaaagtagtactttagcgtggtttttggtaaaccaaaaagatgtataattaatatttgtttaaatgctagaacaagacagaattataaagattaacatcgaagaggaaatgaagtcgtcgtacattgattactcaatgtcagtaattgttgcgcgcgccctcccggatgttcgcgacggctttaaaccggttcatagacgtatcttatatggtatgattgagctgggtaatacctccgataaagcttataagaaatcagcaagaattgtaggtgaagttttgggtaaatatcacccgcatggtgacttttccgtgtatggagctttggtcaggatggctcaggactgggctatgagatatccgttggtagatggtcaaggtaacttcggctctgttgatggtgacagccctgctgccatgcgttatacggaagcaagattaaagaaaataggtgaagagatgatgcaggatctttataaggaaactgttgattttcagaataattttgatgacacgttgcaggaacctactgtcatgccgacacggattcctaacttgttggtaaatggagcatccggtattgcagtaggtatggcaaccaatatgcctactcataatctttctgaagtaatcgatgcatgtattgcttacattgacaataatgatattgatattgaaggacttatgcaatatgtaaaagcaccggatttccctacaggtggatatatatatggtataagcggggtacgtgatgcttacgaaaccggacgtggtagagtggtgatgcgtgctaaggctgagatagaaactcatactacacatgataagatcatagttaatgaaattccttataatgtaaataagaaggaattgattgaaaatatcgcatctttagttaatgacaagaagattgatggtatttcgtatgtaaatgatgaatccgaccgtgaaggtatgcgcatcgttattgatgttaaacgtgatgcaaatgctagtgtggtgctgaacaaattgttcaaaatgacagctttgcaaacttcatttggcgtaaataatatcgctttggtccatggtcgccccaaaatgttgaatctgaaagatttaatcagatattttgtagaacatcgtcatgatgtggtaattcgtcgtactcagtatgatttacggaaggcacaggagcgtgctcatattcttgaagggttgattatagcttctgataatattgatgaagttatccgtattattcgtgctgcaaaaacccctaatgatgctatagcagggttaatagaacgttttaatctgagtgaaattcaggcacgtgctattgtagaaatgcgtttgcgccaattaacaggtctgatgcaagatcagcttcacgcagaatatgaagaagtgatgaaacagattgcttattatgaagaaattctttcaaatgatgaactttgtaaaaaagtaatcaaagatgagttgatagaagtaaaagagaaatacggggatgcccgtcggtctgaaatagtttattcttcagaagaatttaatcctgaagatttttatgctgatgatcagatggttatcacgatatcccatatgggatatatcaagcgtactcctttatcagaattccgtgcccaaaatagaggtggggtaggatcaaaaggaagtgaaacccgtgatgaagactttgtagagcatatttatccggctacaatgcacaatactatgatgttcttcactcagaaaggtaagtgctattggttgaaagtttacgaaattcccgaaggaactaaaaatgccaaaggacgcgctattcagaatttgctgaatattgattccgatgatgtggttacagcatatttacgtgtgaaaaaccttaatgataccgagtttattaatagtcattatgtgctgttctgtacaaagaatggtgtcattaaaaagactttgttggaacaatactcacggcctcgccagaatggtgttaatgcgataactattcgtgaggatgataaagtgatcgaagttcgtatgactaacggtgataatgaaatcattattgctaaccgtaatggtcgtgcaattcgcttccacgaaagtgcggttcgtgttatgggacgtacggctacaggagtgcgtggtatgactttggatgaagatggtggcgatgaagttatcggtatgatttgtataaaagatcctgaagctgaatcaatcatggtagtttctgaacaaggatacggtaaacgttctgatatcgaagattatcgtaaaaccaatcgtggcggtaagggtgtaaaaacgttgaatattacagataaaacaggtaaattggtggctatcaagtctgttacagatgggaatgacttgatgattattaataaatctggtataacaattcgtttgaaagtcgctgaggtccgcattatgggacgtgcaacgcaaggtgtacgattgataaatttggagaaacgtaatgaccaaataggttctgtatgtaaggtgacatctgaagaagaggagattacagatgaaaattcaaatgcagattttgaaaatataactgaaggagagggtggtagtatcactaatccagatttaattgccgaagcaaatagtgaagaataaaataaattgtattattaaatccacaaaatcatgagaaaagtattatttacagtggctttattgttaacagcttgctttgtgtctgcacaagtaagtgttgttaaggaggctaaatccttgaaaagcaaacctgaagaagctgcaaaagctatcgaaccggctttaactaatcctgaaactgctaatgatccggaaacatggaaattagcaggagattttcagaaagcaatttatgatgaagaaaacatgaaactttatttacctggaggccaagcagatacaactaagctttataacagcttagctaagatgtatgacttctacttgaaatgcgatgaaatagagcaggctaaagttcaaagtggcgagttaaagaaacccaaattcagaaagaagaatgcagatgctttgaagactttgcgtttaaacctggttaatggtggtggtgatgcttacaataaaggagattatgctgatgctttaaagtattttgggttatttgttgatgtagtaaacgaacctatgtttgctgatgatgatgagttgaagactgatactttgaatgcattatatgcttgctatgcaactttagctgctaatatgctgaaagataatcaggctgtcatcaaatatggtaatataggtaagaatcataaagaagaaggttatagagcattaatgtgcttggctgaaacatatggtcagaaagaaggtggtgattctgcaaaatggcttgaagtaatcaaagaaggtactgaattgttccctaagcaagaatactttgttggtaatattatggattattacattcaaaaaggtatggttgatgagggtctggttcaaattaataaattgcttgctacgagtgaaactccgtactatctttatgtaaaaggtatcttattatatgagaaaaagcagtatgatgatgcaattgctacatttaataaaattatttcaaataacggagatttagttgctgaagcatattcaaagattggtgactgttattttttcccagctcagattattgttgaggaaaatgcgaagctagctattgatgatcccaaatacaatgaaaacgaaagtaagattaaagagttgtatgagaaagctaaaccatactatgagaaggcaaaagaattaaagcctgacaataaggctttgtgggggaattatttgctgaatatttattggaagttaaatagagctgaatatgattctttggaaaaagaattaggatattaataaaaacactgattttaaaataataaagaggttgtgttaaaattctggcacaacctctctttttatgccaaaagactttcccaagcccgggttttgttattacctaaagttttatgtatctttaaaagtttacccattacatacatccgtttacgagaaccatttttgatatataatcaatattatgtttaatttatattgatctcttttttattgggtagatattaatatgttaaagagtaacaaaatattgcgatttgcttgtgctacccttcttgattctttattttattactaatataggtgtattagcatgaaatatcatttttcttgctatgctaggattaaacaatctagcaaatatgtttcgtttatagtttgtgatacaaattacgtctatattttcttcttttacatatttgtccaaattgctcagtatgttatcttctttcactacattataatgtagttccaattttgagtattgtttttgaaaataatctttaatacctgctagttttatttcatgccatgcatcattatctgtacttaaatgaacgaaggaaacggcaaaatgaaacgatttaaaaacatttatcaaggagtcaaaagctattagatccctttggtcaaaattggtcacaaaagctactttttttatgtcattgaatgtttttaatggtgtatgttctggaatagcatatacaaaggattggcttctttctatgacttcggccgtaacgctgccaatcaagtctatatctttttgacttcttcctcttgttcccattataattatctgaggattatattctttagcatatcgtaagatttcttcttcgggaatgccatcacgcaaaatacaagtatattttatattgggaaactctcctgactcaactttctttttaattgtatcggaaagtttgttcaactcgttgtgcactgtttctatcatactttttacagattcttctctttcgatctgaaaattgaaattatcagttccataaggaattgtaggcacataaataggactgaaataagcatgtaaaagcacaacttctgaattaatagcattagcaaaagagaaaccaaattggcaggctttaagggaatagtttgaaaaatctaccgggataagtacttttcttttttctttgtttttttccgagctactctccttccctttgattatatcttctgaaagccatgcagaactttctataatttgcaaagcatggggcagatcgctttctttaattcttagtcttaccccagaagatataacaggttgaataagattcacattgtgaatgtacgcttcaattccctcattctcaagcacattctttaaaatctgagctttagcgtaagtgaggattgctaaggttaccaatttatcttccataattctatattttaagtgattttcaggttaaacaaaaaatcccaattgaatgttgcaattcaaccgggattttatattacacttcttgcgttattttttcttcagtttctctcaatatttgaagggctttttcaagaactgttgtatcatctagcattactagtcccccatctggtcccggttccaaatgaattccaacacttttaccattcttgaaattgtgtccaccaaaaaagttacgtacagtttctacggtcatattgagttcatctgcgattctgtgcatactcccactaggtaatgaatctttgattctgcgcagttcattaaatgttattgttctcatgatgtattaaatttagttataaaagtgagtacttaaatcatggtataaacttaatcaaaaaaatgcataaaacaaatctttttgtgctatttttgactatatgtaaatttataatggttaatttgctgattatagattgagtgtatgagtcacaatcatacctgctataataatgaagaaataagtagaaatgagaattatgtagaataaattaatatcactaatcaaataaccgctggcagtgtattgattagaaatgcaacgtggtttataaaagatttttttttgaataaatttataaaggagataaatcaaatatcctatgaaacaaccttctatagcaccaaaaagaatatctcccggataatgcactcctaagtagattctagaataggaattgagtacggcccaaaaaagaagcataaaagtaagagatttccttttaattagtaaagataaaaagacagaaatagcaaatgtgttggcagcatgactggatatgaagccaaatcgtcctcctctatatccgtttacaatatcaaccatatacataatattggggtcttgtgttggacggaaacgtgcgaaaaacggtttgcataaaccagaagctatttgatctgctaaagttatgactaaggcaatcataacgatagtcaataatgcttcttgaattttgttatttttaattatgatatataacagcatagcagctacaggtacccatacaattgtactggtagctacccacatgaatccgtcccaaaataaggattggcttccgttcaaattcagtagtaattctttatctgctgctatgtactgttgtatatccattgattatgttttaaatgatttcaataacattggtaggtacccatcccacattaccgtcttccagtttaatttctttccactccttcatcgtattatctttaattattactttcctaccttcatgaagaataaataagtctgttccactttggttaggagtacttttgactgtaacgctaggagccattataatagcgttatcatgattaattaattcagatttttgttctgaggcaaatatatttgctaaaatggtcactagaaagaaaaagattgctgaaataaatcctactttcttcaagactactcgttttccgaaaataaataaagacagtgccaatatcatcagaataaacatgataatgcctgtatgtgcccatgccttttcactcattgtattaataagtgattgagtccaggtaacaaaaaacattttactagaagggattaccttgtctacagttttgcttcgagccagttctaggttgaaacgaatatcactatttcctgggtttagcaacaaggcacgttcgtaattaaggacagctttggcaatgttattcattttataatagctgttacctaaattataataaatatcggaagattccccctcgttttttaatatattctcatacatctctacagaagctgcaaagtcgtttcttatatatgcactatcggcttctgtctttgttgggaaagtttgcacagcagcactttgtggcatttctgtttgggcggtaacctgtgcagagtctgattcattctgtgcgtagactgtgacaaaacttatcaggaatatcaaaatgaaatatatttttgtcattgttataatctcctttgatttagtgttttatactattctccattttgctgatgacctcaacagccgaagaatatactttatccatagcttcattctgattacccggagcatagcgggcgaactcgcattcattcaatgttccgatgaaatctttaatcagttcgggggcaacaccatatttggtcaattcgtcctcgatattatctttagacaattgagaaaccgggatattcaacttatcactgatgtatccccaaagtgctttcaacacctcatcatagaatgcttcttgtttgttttcagctaataatctgcctgcatttttcatgcgtttggcagccactttattcgcttttttagtacgtacttttgctacatttgcattttcaatagcttttttacgatagacaattacgaaaacaacgaagagaaccaatggaatgatataccatagataatatgttgttgagccaaagaagaaatctcccttacgagttaaactagtttcccccattttgatgtaacggatgtcttgtcccaatactttcaaatcttccttgttggtaaagtctgcaataacttgatctgcatttcctgcacctttttccacttttaggttgtaagcttctgtttttattgttttatagctattgctttttaagtcaaaataggaaaattcgacaggcggaatagtgaaattgccggcatgtcttggaattgctagatattctatcaccttattgcctgacaaaccttcgcgagttaatgtaaatttattgtcaatcttggggtcgtatacttcaaaatcctttgggaaagctacttccggagtattgaccaatttcaaattacctgtaccagaaatgactaacttaatggttacagcatcatttgttttcagttcttttgtacttatagacgaactgatagtaaactctcctactcctccggagaaattaattggtttgccatcgggcaatgcttttacgttgatggtcagcttaggagtaacaatgtttttctttacttccacatagttacttccaccattaaagaaagcatcaaaaggatcgtctgaggcaacttgttgagctataaccccttcaaaggtaatagccggaatttctatttttcccgattgctgggggaaaagtacatactgactccacacagtagtgttatagtttcttccgttataatgttccaaagagaatgtcttttgttggggaagttccacttcttgtacataaatgttggttagtttaggcatgtcaccacgcagttggcgcaagtttaccaaagtatagaccttgtatgtcaacaagatggcttcctgttcataaacagtagtcttacttgctgttgcggtaataaacaaatcttgattggttattttgcttccggcaacctgactgcgtgaagaagttcttccaccgctattgtttccacctccaacaccatttgtttgatcaggcggtaatactttgatttgtacggaatttgaagttttgttttgtccgtctgccacaatagtagcaccaggaatggtgtaagttccttctttatcagccatcaaaatataagtaaaagtaatggagctggtagaagtaacattaccatttataatctgtgtactactctgctgtgaacggcttggtcccattaagacatcgaaccccttgatattaggtgcacgaaaatccctgactttatgagtgttgaccgtataagtcagccggaactgatccccgcttactactacatcaggcgcagaagcggtaaacgtcacatttccgtctgcccatgctccgagcaccgatgttattaatatgaataagagaattactttcctcattgctatctaattatttttttatttgccaaaattaagaaattaccagtctttatccaacttctttccttgaatttgcagttgttttttaactttatcttgcacattcttttcatcttgcatcacagcattcaataattgttgggcattttctttggacatttcatccttattttgctgctgttgttgctgattttgattttgttggtctttcttatcctgttcttgctggtctttgttctgatcctttttgtcgtctttctgattttgtttttgatcttgattcttatcctgattctggtcttgattttgctgttggtctttcaacagcttttgtgccaaagccaagttgtaacgagtttcatcatctttcgggttattccgtaaagattccttataagcctctatacactgtggatactgcttggacgactgaaggataactcccatgttatgataaatctgtgctagtttatctctatccttttctacttttgaagcagattcaaactgttccatcgcttcctttgctttttgctgcatcaagagcgagtttcccaaattgaacatagcatctgttgatttcgggttaatttccaatgccttacgataatctacctccgctttgataaacaaactgtcgttatacagcttgtttccactgcgcagataatctctttctgttttttgggcgaaggcacagcttgccacaagtaagaataacagagtgatataggttttttgtaacataagcattccttatttaaatagtctgacatttttgaaaagcggattcttccgttccaaaataagcatttctaccaccagcaggataagcaccagccatgccaaagcctggaactgttcatcgaattcagtataaacctgactttctacatcagcttttgacaatttagcaatttcattgttcaacaccttttcggcagagttggtattatctacgcggatatacattccattgcctgccttggctatttcctggcacatttgctcattcaagcgggtgacgatgacatttccatctttatcgcgacgaaaattgttgctaccattctcagctggaattggagaaccatccggtgaacctacccctagtacaaatacctgcatacctttttcggctgcttcctgggctgcttctactgccccaccttcatgattctcaccatcggtaatgacaataatcgcacgtcccactccttcttgtggagtaaaactcttcattgccaggcggatggccgtaccgatatccgtaccttgtgtggttattaatgacgggttaatggtttccaaaaacatcttggcagaaacataatcgcttgtaataggcaattgcgtgaaagcatcacctgcaaaaacaatcaatcctactttatcattattgaacgtatctaccagtctggatatcaatttctttgatttgtccaaacgactgggagtcacatcttctgccagcatagagtttgaaatgtctaatgcaataacagcttccactccacttcgtttcaccgtttccatctttgagccgaactgtggacgggccaacatcagtataaccaatgtcaacgcagcaaaagtcagccaaaacttgatgtcaggacgatacttggaaatagtcggcataagccctttcagcaatgccggatcaccatatttgcgaatattttggcggcggtgataattggaatacaaatacagcgccaccaaaaacggcaataggatgagtaaatataaaaagttcgggtctgcaaatcgaaacatgactttctttttttaaggtattttctttaatactgagttacgcaacaaaagttcaagcaaaatgcagaagaaagcaatccaggcgaatacctgatattcttcttcgcgtttgctgaattctttcacgttcaacttcgttttctccagtttgtcaatctcctgatagacttccttcagcttggaattgctggtggcacggaaataatttccgttcgttgtacctgcaatctcggtcaaagtcttttcgtctatctcgacggggacattcacatattgcgtccctgcgtaggtctgcatcggataaggagcagttccgtttgtaccgacaccaatagtgtagatcctgattccgaactgtttagctatctcggctgccgtcagtggagaaatatctccacggttattactaccatccgtcagcagaataatcactttcgatttagccttgctgtccttcagacgggtcaccgcattggcaatgcccataccgatggcagtaccatcttcaatcagtccgcgctgggcgatatcgcctttaatgctgttgaacagattcagcagtaccccatggtctaccgttagcggacattgggtaaaactctcaccggcaaagatggtcagaccgatattatcattggggcggccgttgataaactcggaagctacttgtttggcggcttccaagcggttgggtttcaagtcttcggccaacatactggtagaaacgtctactgctagcatgatgtcgattccttctatttcggtattctgccaattgtctgtggtctgagggcgtgccaagatcaggattaccatgatgatagccaccgtacggagtacgaacggagcatgcagcaagtaaatcttccagcttttgggtgccttcatgtacatgcgtgtggtagaaacctgaagcgtaggctcggttttcttccgcttcatgacgtaccatattatataaggtatgagcagaatcagcagaaatagatattcaatatttgcaaaaatcattgttcctagtatttatttgttaaaaccagaggttatatacaccactcagcaccttatatagaattaccacaatcgcaataacaatgatgctgatgctgcccagcagaatcattctgccctgtttgcttcgcttttcctccacggtgatttccgtaggttcgggctttgcattcgggtctggttccacttttgtattattgataaagtctactgcgtttaccagattcatatcgttttcattcatcaacggagaatgtttggcgaatttcaccaagtcggcagtctggaacaaatacatcaaatccttgatagactctttgtcgttgatttcctgtagcttatcaataatttcggatgaagtcatctccatagcgttaaagccgaatcgttcttccatataagtacggagtacatccgtcagctcggtataataggtcttcggatcggctgtacgcaaggttttgtctcccttgatacgctctatttccttcaacgcctgctggtgtggcggcaacttcggttcaatcttgatcttcttgatgataggcttgttatctttgtagcgtacaaacaggtagtaagctagtccgcccaaagcaagcatcagcaaggtaagccatacgatggccgatacgtcatcccaggtgataggtacttcgcgaacggtcttcggtccgaagaattgttcgggatgcagcgtatctaccggaatggaatatacttttacggccaatgctttggaccggtaagactctccgtttaccatcacctcgaatgggggaagatagtaaagtgccgagtcaaaagaagttattgtatattcctgttttatcagcatacgctttccatcgttcagcatctgggtatcaggcttggctatatccaatatctccactccttttaccaatgtatcgcgtaggaacggaagttgcagtttttgcttggcatccatgctgatttccagcttcactttagcctgttcgccaatgagaagctgcagcgagtcaatgctggcgtctaccgtaacctgctgtgcctgtgcctgtccggctgttatcagcataattgcacaaactccagctttcaagaactttttgctagtattcagtatattcatattctttaatttcgtttagcaaataagttaagcaacgatttcacataatcctgatccgtgcggatagatacagagtccacattacttttagtaaatgtttcattcaatactccctgacgctgtatccaccagtcattatgtgcgcgacgcaaagctcgtgacgaggtgtcaatccattgctcgtggccggtttcggcatcgcgtactttcatcagtcccacatcaggtaactctgccatgcggcggtcgtatacctgaatagctacgatatcatgtttccggttggcaatggtcaaagcattgcggaagtcgttttcatctataaagtcgcttatcataaaggtggtgcaacgttttttgatcacgttggtcagatattccacagccgtttttatatctgtacgcttgctctcgggcttgaaatcaagcagttcacggatgatataaagaatatgtttacggccttttttaggcggaatgaatttctcaatccggtctgaaaagaaaataactccgattttatcgttattttgaatggccgagaatgccaatgtagcggcaatctcagtcaccatatccttcttcaactgcttcaccgtaccgaaatccaagctgttcgaaacatcaatcaagagcataaccgtcaattcgcgctcttcttcaaacaccttgacaaagggtttgttgtagcgggcggttacgttccaatcaatgtcacgtacgtcgtcaccatactgatattcacgtacttccgagaatgacatacctttgcccttgaatgcagagtgatactgtccggcaaagatattgttcgaaagtccgcgtgtcttgatttcaatctggcgaacccgttttaataaatcacttgtttccatactgttcgtactatgttgtttatttatccggcgcatcggtttctgttttttctcctatcgagaatggtttttcaaacggatgcatttggtgttccacccatgtggaactctgtactcaaccttttgtttccaaggtttcttcctaattgtcaagcaattaagaactgcctcagaacacaatccttagggtacttccactttattcaggattttgcttacaatttcatcagaagacatattcatagcctctgcttcgtaagtcaagccgatacggtggcgaagcacatcgtgagcaactgcacgaacatcttcgggaattacgtaaccacgacgtttgatgaacgcataactgcgtgctgccaatgccaaattgatagatgcacgcggtgaaccaccgaaaccaatcatgtctttcagttctttcaagtcatatttttcagggaaacgggttgcgaatacgatatcagcgatgtattgctctatcttttcgtccagatagacttggcgcaccactttacgggcttccataatatctgttgctttcagaatgggacgaacttcgattttctctccagtaatattttggcggatgattttcttttcttcttccagtttcggatagtcgataataactttcagcataaaacggtctacctgggcttcgggaagcggataggtaccttcctgttcaatcgggttctgagtagccattacaaggaaaggttcgggtagcataaaggtttccttgctcagtgtgacttgacgttcctgcatggcttccagcaaagcactctgtactttagccggggcacggttaatttcatcggctaatacgaaatttgcaaaaatcggacctttctttgctatgaattgttcgtctttctgactataaatcatggtaccgataacgtcggcgggcagcaagtctggagtaaactggattcggctgtacttggcatcaatcaaagatgcaagcgttttgatcgccagagtctttgccagacccggaacaccttccaacaggatatgaccatcggacagtaaaccgataagtaatgattctaccaaatgtttctgacctacaataacctggtccataccagtcattaagttggttacgaacgcactttgtctttcaattcgttcgtttagttcgcgaatgtcaattgcttcagccataattttgtttatttagttgtttctttattgatctaataacgggcttgtaaatagccttgttcatttaacgcagccaaaattacggtaattaattaacagcggcaactaatttttattaaaaaagtaaagtgcatctctactttttaaaggttattgggctaaagaattttaaaatacaaagataaggtttgtagagtgagaatatcagttgagcgcactttttttacttcttgtattttgcctgctttatttaagtcgaaagcaggcaaaatacaagaagtcttattttttaggagttaattcaggaatacgcagagtagtccctatgggtactctgtcggcatctttaatgatgtttttattatgtttcacgatatagggccatagcttttttgtaccatagaatttcactgctaattttaccaggctctctccttctcgtaatgtgtaattagttttagtccctgttatgtcatattctacagtgtcggctaaagtttctttttcaacatttgcagttacagcaacgccagaactctttttcgtactaggagatacagcctgttgtgattgactgatggtttcttttctagtaacatccgtccatatgtttgcggtatctttaccttgcattaatgagtcattaaccggaattgcaggaatatcctcttccaattgttcttgggtgttttttattgtagccggcgattgtaaatccgaagttttatctgattgcaaataccaatatatgccacctgtgatgcagacaatcaaaatgataacaagaataattccccgggaaactctgttctttttctctcctgagatttcttgtgcttctgttgtttcctctatcttctgttctttttcaaaattagaagtaacagttaccgttttttctgacggggttgcctcttgtggcactattatttccaaagatgttttttcttcacaagctttatgagcagccagtatggctgcatcggcaatagtcataacttcttcttgaggtttgtctgttaccttgtttccttctattgtttctgctaaaggagaaaccgtttggggaacagccgtttcaacaacaatatccttttctgcttcagtgacaatatcttccgatttctttcccggttctataatttgtatctcttcctttgtgatttcaacagaaggtacaggttcttcaataattgtttcctcaataaccggaatagtgtctttagcggcaatgggattctcatttggagaatcttctgtattttccgtttctatgagttcaacctctttagccgcaactgtttgtttaggcttaggcgcgttttcgtcaacggtatcttcctcctctccttctatttctgtttcggtatcttccaatttggtattctcatttaatataaccgtttcaaaatgagcaaatggcttatttattaaatctttcatgctggaatccggagtaaaagatatttttgtatgaccctgtatttcaattctttcccccgtatttacgtttacactttcacgactctccacctctgtgagtttaaacgtacctagtcctttaacctttacatacttttcagtagctagagcttcctctatcagttcaaacattcctttgacaaagatttcagcatcttttttagtcatgctgtgtttctcagccaaaagttcgatgatatcttgtatggttactttctcgctcatgataatattataaataagggctattttatttaaacttttcttttaaggttacactgggtttgtaagtcagcactaacttggggggaatcagcatacgttgttgagtagccgggttaatagaaattctttccaattttttcttaacctcaaacgtaccaaatccctgaattacaatgttgttgccatcttgcaattcttgggtcataacaccaatgactgaggataccaattgtgatgtatctttatttgtatatcctagtttacgtgataattcagatataaattctttgttattcaaagcttaaagtgttaatttggttgctatattagtaaaaaaacaaacattatccaaactttatatgggaaaaagcctataaaatgctggcgtataggtcaaaatcatcagcggctgtaattttcactttatagaattcacctatttttaagtactcgtcatcagcttttatcaagacctcaggatctacctcaggagagtcaaactgggttctgcctatgtagtaatctccttccttccggtctataatgactttgaattctttacctattttcgtttggctcagttcgccggctatttcctgctgaagtgccattaattcatccaaacgctgttgtttcacttcatgagaaatggaatcttcgtattctttagcggcgaatgttccttcttcttctgagtatgcaaaggcccccatccggtcaaatcgtacttttttgacgaattcttttaattcttcaaaatcttcttcagcctcgccgggatgtcctaccattaatgttgtacgtaagtgaataccgggtacttcccgacgaaatttttcgattaattcgtaggtttccgctttacttacgtgtcggcgcattttattcagcatattgtcactaatgtgttgcagggcgatatccatatatttgcatacattatcgtgttcgcgcataacacggaataattcttccgggaaatgcgccggatatgcatagtgtaaacgtatccattctacaccgggaacattagcaattctttcgatgagttcgggcaatttctgacttttatatagatctacgccgtagtaagtcaattcttgggctataatttggaactcctttactccttcggatacaagtagtttcacttcatcaataatctcctccatcggacgtgaaatgtggcgtcctgtaataataggaatggcacaataagaacatttacggtcacagccttctgatattttcagataagcatagtgatgaggagtggttaatgtccgttcaatggtaaattccgccttgtatgctttgcctaaatctgccagtaactcattccaattaaacttaccatagaatttgtctacttgaggaatttccaatgccaattcttttagatatctttctgaaaggcaacccattacatatagttttttgagttttccttcttctttggcctgacaaaattccaatatcatattgatcgattcctctttggcatcgccgataaaaccacatgtattaataactgcgatttctccttgcggtttatcggaatcatgagttactttataaccgtttgcttccagctgacgcatcagcttttctgagtctactaagtttttggaacaccctaaggtgatgatatctattgtgttacgtttcatttattattcagtctctccaaatagtgagtctacaaattcttttttgcggaatacctgcatgtcttcaataccttcgcccaatccaatatattttacgggaattttgaactgctctgagatgccaattacaacgccccccttggctgttccgtccaatttggtaattgccatagcagtaacttctgtagccaaagtaaactgttttgcttgttcaaatgcgttttgaccggtagaaccgtctaaaaccagcaatacttcgtgaggtgcgtccgcaacaactttcttcatcacattcttgattttagtaagctcgttcatcaaacctactttattgtgaagacgacctgcggtatcaataattactacatctgcattattagctacggcagagcttaaggtatcaaaagctacggatgcgggatctgatcccattttctgtttaataacaggcactcctactctttctccccaaatatccaattgttctacggcggcagcacggaatgtatcagcggcacccaaatagacggatttgcccgccttcttaaattgatatgccaatttgccaatggttgtagttttacccacaccgtttacacctaccaccatgatgacatagggcttcttaccttccggaacagtgaaatcatccgaatccaccgtgttattttcagtcaataatgccgctatctcttcacggagaatcttgttcagttcctgagtgtttacatatttatctttggcaactctttcttcaatgcgtttaataatatttagagttgtttcaacgcctacatccgaagtaataagcacttcttccagattatccaatacttcatcgtctacttttgatttaccagctacggcacgggcaatcttactaaatacactttctttggttttggacaatcctttgtctaaagtttccttcttttctttcgagaaaaaattaaaaaatcccatattggagtctgatttatctgtttatgctacaaagatataactaatctcttacacggacaaaaaaaagtgtcacaatgattggtcataatgtattatgatgataacattgtggtataaaaaaagttccttccataatatatgaaaggaactttccattagtcttccgactgaattatttcttgaaaaagtcttgaactttttcgttaggtaccatttgctcatcgaagatgtaagctcctgttttcggagatttaaccatcttgataaccttagtataagaacgtccttctttacctgtctgaagggttgcgactgttttctttgccatgggttataattatttaatttctttgtgaactgttactcttttcaaaataggattgtacttcttaagttccaatctttcagtggtattttttctattttttgttgtaatgtaacgagaagttcccggcataccactatccttcatttctgtgcattcaaggattacctgtactctattacctttagccttctttgccatagtctatctctcctttttaattaaccaataattttgatgcttttccaatcacaatagcctttggttaccgcttcattcagcgctgcatccaagccttttttattaatcacacgtaagccgttagcgcagatattcaggctaatccagcaatcttgttctacatagtagaatttcttagtaaacaagttcacatcaaaagttcttttggttcttctcttagagtgtgaaacattgttgccaatcatggctttctttccggtaatttgacaaatcttcgacattgctatcttatttttatagtttttttcaatacttatttcaaacggagtgcaaaataagcacttttatttgtataaaacaagagtttttgcaaataattctgcaattactgctcattttcttcgttttggaacaactttcggagcagttgcagtgcattttgggttgcatttgcaatgtttttgtttcttccttcgtcgccttccaatttcagtgtaatcactttgtctttacatccggcagcaatccaaatggtacctaccggcttgtcgggggtacctcctgtgggccctgcgatacctgaagttgctacagcacaatcagaattcatcgatttcatcgccccttttaccatttcgataacggtttcttcacttacagccccatgagtttctaaagttccgtggtttacccccaacagattttcctttatttcgttggaataggcgataattccacctttaaagaagtgtgaacttccggcaacggctgtaatagcggccgccacacttcctgccgtgcaactctcggcagtaacgagtgtcaggccttctctccaaaacaaatcgttaatctctttacttaaaaatttaccttctactgacatgttgaaaacggtttttaaatatttaaatagttacccgtgaataagcgggcttgtctatagtgcaaaaatcattgtccaggtacttgtaataaccggtaattgcgatcattgcagcattatccgtagtaaagctgaacttcgggatatagatattccaaccatatttcccggcatgttcgcggaatgagttacgaagcccgttattggctgatacccctccggctactgccacttcatttattttgagatttttggctgcttttctcagcttatccattaaaatatctacaatagtcgcttctaatgaagcagccaagtcgtttttatgatgctcgatgaaatcgggatcttctttcaaccagtcacgcaaagagtataggaaagaagtctttagtccactgaagctatagttatagtccggaatatgtggtttactgaaagtgaacgctttgggattgccttgacgtgccagtttatcaatgataggacctccgggataacctaagcccattactttagaacatttgtcgatagcttctcctgctgcatcgtcaatagtttgtcccaaaacttccatatcattataggcctttaccaatattatctgtgagtttcctcctgacaccagcaggcacaagaaagggaatttaggttcgttgttgtcttcttccgattctttaatgaaatgggctaacacatgggcttgcaggtggttaacatcaatcattggtatatttaatgaacgtgcgaaacctttcgcaaaagatactccgaccagtaatgatcccatcaagccgggtcctcgggtgaatgcaacggcgcttagttgctccttggtaactcctgccctttttaaggcttcgtgcaccaccggtacaatgttttgttgatgggcacgtgacgccaattcgggaaccacccctccgtaagcttcgtgaacagcctggctggacactacgttggacaacaatacgccattcttgataactgcggctgatgtgtcgtcacaggaagattctatacctaatataattgtatccatatttctataccttaattatatatattaatgtgtcagaatttcaagtccgttatctgtcataacgaaagtatgttcccactgtgcagacggctgttcgtcttcggtgactacagtccagccatcttcctcatcaatgaagacttcccatgttcccatattgatcattggttcaatggtaaaaaccattcccgggaccaatagcataccagttcctttttttccaaaatgttctacatccggttcttcatgaaactctatgcctactccgtgtccgcagagatcacgcactactgagaatccattttttttagcatgtttttcaatggtatgtcctatgtctcccacaaaaccaaatggttttgcagcttccatgcctatctccaaacattctttagctactcgtaccagtttctctttctgaggtgtggtttttccaatggtaaacatacgcgatgcgtcggcataataaccatcaagaatggtagtacaatccacattgataatatctccttcttccagaatgtcgaattcattaggaataccgtgacaaacaacctcattgatagaggtgcagcaactttttggaaaaccttcataacctaaggttgcaggaatgccgccatgatctttagtgtattcataaactagtttgtctatttccaatgtgctcatgcctgcatggatctcgcgttctacaaggtctagcactccggtattgataataccgctacggcgtattccttcaatctgttctggtgtcttaatcagttcacgtgaaggcaccaaatgacctctatcttgataatagagaacctttttatctaactctgtgagttccatacctttgggcactctccagtttattttatttcttttcatatcaaaggattaattgacttacaaagttagaggaaatatttgtaaaaatggctcatccggcaataaatatcttcataaaaagagaatttacatgaaatttgacagaaacaaatgttaaataatcatgtcttttacatgaattttatgtaggagagtctattttattttaataaaaggttatatttaccgcaaaaaactaagcattctattattaacttctttaattgaacatcaaaatggataaacatcaaattggagtaaacgcaggaaaagtttggaaactgctgaatgacaataaacggtggagttattgtgatttaaaaagagcttcagagttgtctgacagagatttgaatgcagctataggttggctggccagagagaataaaatagactttgaatgttctaacggagacgattgcctgtttctgagcgtcaatgtttatattggctgaatacgagaaacagataattatgtggggccaaaactttcataattatctgttctctttttttaatcaacttttctaatcactttggctggattacctacagcaacggaattgtcgggaatgtctttagttacgacacttccagctccgataatacagcgatgacctatttttactccgggacaaagaatagctcctcctcctatccagcaatcttctccgatagttacgggatatgcatactctttgggttcgcgtcgggttatgtaatctaccggatgatgtggagtatagatctgtacattgggtcctatcaatgtatgtgctcctatggtgatatatccaccgtctaaaaatgtacagttggcattcacaaagacatgctctcctaagcggatgccgtgtccatgatcacagtaaaatggtggacagatgacagaagtggaagggatacccggcactaattcttccagcacttccctgaaaccatcatcgtatgtactcatcatccgtaattgggccactagttttttggcgtgtatgaaactggcctgtatttccggtttctccatatcggccagctgactgttacgcattttgtctatctcgttcataattaaagggctttaagatttcgcctcaaatgtaggatttgttttccgttctgccaaatatacaccacacaagataagaaaacagccggtaagggctatccaagttatcttttcattaataatgaccgctgaagtaagaagagttaccaaagggacgatataaatatagtttgtactttttacggctcccaattccttgacacatgcattccaggctatgaagcagagcatggaggcgacaaatcccaaaaagagaagatttccaaacacgatgggttgcatcatcaagacattgtcccaatttaacggacggaataaaaacatgggcagaatggtcagcactccgtagaagaatactttacgggtaatgaatacgatagaataatgattatccaattgtttgagaataaggcaataaaatgcccacatcaatgcagcggtcagtgaaagaatatctcccaaaggattaattttcagaatgaaactgccgttgaaaacaactagccccactcctatcaaagccatgatcgatccgtaaacaagatggcgggtgaaaggttcttttcttctgaacaaataagaaagtagtgtggtcagaacaggtgatgtgcatactatcagagacacgttggaggctaatgtgataccgagagccgtattttcagtaatgaaataaatagttcctccacataatccggccaataaaagtaacaattcatcttttattctattggcaaatagttttttataagaaatacaccacatgcaaagataggccagagtgaaacgataaaagaagatgtcggaaggacttaatccatgttggattagaatcttagtagaaacaaaagtagtcccccagatagctacagtgattattgccattaagtgatagacgaaccttgatttgattacattcataatttatatgtgttttattatgttgcaaagataggttttgttttcgagaaacttatcaaaatatatggcatagttgagctgatacaaagttcgtttgttttctcacttaccttgggcgcggccctcaaggtaagtgagatatttctatttctggggaatccaggaatctaccagctcctgatgttcttttacccatttttccgctccttctttttcattatattcattttgtgatacatcatccagcaagctgctgatttcttcggtgctcagatgtatgttttctatcagttttaccacaaacgggtgttgctcaccaaatcctttgcaggcaatggctgtaattgtttccgctttaccaaaaatgcctttcgggtcttctaaaaattttaatttaaagcgggtgaacatccaatggggagtccatcccgtcaccacaatccattgatgttcgtcaatggccctttttagtactgcggtcatagccggtccgctagactccagcaatttgtaatccagattgtatttttctatggccatatctgcagcatgcataatccctgcgccggcatcaatgccgataatctcgcctccgaatttttctttgttggcatttaattggtcaatagaatgaatgtccacataatcggggactaccagaccgatacgggcatctggatagatcttgcctaagatttccagattctttccgtattgtttcatataatcggcctgtgtggccggtaaccaagcatccatcagcaaatctactttgccacgggccattgttgcatagataggagcaggatcagcattctttaaaatgacatgataaccttgttgttcaagaatcacttccgttaaataggtcagagcgatgccatcgtcccagtttatgtatccaatgcttattgtcttatcatcttttttcccgctgcaagaggtaagcaacaggaggaaagacaaaaaatatagtattttcttcatgcttatttccctttcttttgttttccaagtccttgtgttattctatccagaatgatggctaggatgactactgcgataccgccttcgaaacctaaacctattttcatctgcgtgatacctttcaatacgatttcccctaaccctccggctgcaatcatagcggcaatgaccaccatggagagcgacattaggattgtctggtttataccggtcatgatagtgggcaatgccagcggtaattgtaccttgaataataattgcataggtgtcgcaccaaaagagcgcgaagcttctataacattcttcggtacttgcttgatacccaggctggtcagacgcactacgggaggcatggcaaaaataatggtggcaaaagctcccggaacggttcccagcccgaaaaagagtacggcaggaatcagatagacgaaagcaggcatcgtttgcatcaggtcgaggataggatgcagaattttatcacatcgtttgctgtttgcgctccatattcccaatggaagtcccatgataagagcgatgatggtagacgaaagcaccaatgctaaagtctgcatggtttcgttccaaaatcccattccccaaatcagtaataatcctaaaatggtaaaaatgctgactccttttcccgatttataccaagccaggatggccagcaatgctattgttacataaaaaggtatccacatcaatatgttttggaacccatctatgaacccgcctattccaacattgatggcgtcgaaaagaggggcaaagttttctgtgagccagttgatggctgtttctatatattttcctatgtttatcataattcgatagcgttttgaataagttcattaatttcttctttatcttttccggtcatctctactacgatggacgatagaggaaccaagcctttcagttcgcgttcttcatttaccacataaatgggagaattggttttcgtaattaagggaagcagatcctcaatctttgtgtcctccgtaacggaatgtacttcactttgtacggcttccttgattgattttatacctttatgccgaagaatggcggcactttccaatgtaatctctcctatcagcttgtcattttcatctatcacaggaagcacggtaatatctctttctttcatctttctgatcagaacctcgggaccttctttacgcagacgggctacggcgggacgggttatcataatacttcctgccgttatgattttgctccggtccacattttctacaaatcttgccacatagtcattggctggttctgttaaaatttcttctgaagttccgacttgcaccacttctccgtctctcataatggcaatgcggtcacccagtttaattgcttcgctcaaatcatgcgtgataaagacgatggtctttttcattttggattgcagcgccagcatttcatcttgcatttgtacgcggatcaatgggtccaaagcggaaaaggcttcatccatcagtaatatttccggatcatttgccaaagcgcgtgccaacccgacacgttgctgcattccgccggaaagttgtccgaccatctgattctgatatcctttcagcccgactatttccatactcttcatggcttttttctcacgttcttgtttgggaactccttggagttcaagaccgaatgcaatattgcttaaaacactgcgatgaggtaacaaaccaaaattttggaacaccatagctatctcccggcgacgcatttccaacaattccttatcagatgcggcagtaatatctgttctattaatcagtacttgtccttttgtgggtttgattaatcggtttatgcagcgcaataaagttgatttgccactacccgatagccccatgattacgaagaattctccttctttgattgtcagattggcgtttttaactgctacagtacaattagtcgcctttaaaatttcatttttgctttttctttctttcaacatccggaacgctttctgcttttccggaccgaaaacaagatataagtcttttatttctattttgttcatagtctataatagtttaaattaattaagaatagggaggaattgacggaagtaaattgagatgtcatccggtatatttaacgaaacaaaatataaaaaggttcattataagatgagtttaattgatcagtaaatatgtttcttacagcttgttattgtttactccctacgggagtggttcagaaaatccgagattaaaaaagataatcagaaagcgttttctataaaacagaaattaagtattatccttttgtcgagcgttcattttattctatctttgtcccgtaaaacagaataaatatatggatagtattttaattattgatgatgaaccgcaaatacgcaaacttctttcgcgtatgatggaattggaaggttacgaagtattccaggcagccgattgccagtctacattgaaacaacttaagttacataatccccaagtggtgttgtgtgatgtgtttttgccggacggcaatggagtagatatggttacaaccatcaaaaaactctatccagaattggaggtgatacttttgaccgcccacggtaacattccggatggtgtgcaggcaatcaagaatggagcctttgattatatcaccaaaggggatgataataataaaattattccgttaatcagccgggctatggctcaggctaaaaagaatgtaggggaaaaagtgaaaacagaagaaacccaaagtttctcttttgacgctataaaagggaagtcggagggtatgcaacaagccgtagcattggcccgaaaggtttcggcaacggatgttacagtcttgctgaccggagaaacaggcacggggaaagaagtctttgcacaagccatccatcgcaacagtcttcgcaaagagaatgcttttgtggctgtaaactgttctgcttttagcaaagatctgcttgaaagcgagatattcggtcataaagccggttcgtttaccggagcgatgaaagataagaaggggctgttcgaagtggccgataacggaaccatctttttggatgaaataggtgaaatggctttcgagctgcaggccaaattgcttcgtgtgctcgaagcgggagagtacatcaagataggcgacacgaaaccgacgaaagtgaatgtccgcgttatctccgccaccaatcgggacctgaaaaaagaaatagaacaaggtaatttccgtgaagatctttattatcgtctttctgtttttcagatacacctccctcctcttcgtgagcgcaaagaagacatcgaacttttggcgggaagctttatccaactcttttcaaaaaaactggggaaacaagtggaagggatggctccggagttcttgaatgctttgaaagctgccgactggagaggaaatatccgtgaattgcgaaacgtgatagaacgcagcatgattgtctgcgacaaacagcttaccttacaagatcttcctattgaaatacagaatacccgacaggaagattattccggcaagaattattcggagtttgaactggccgctatggaaaaacgtcatattgctaaagttctgcaacatactaaaggaaacaagactgaggcttcacgtttattgaaaataggtttgactactttatatagaaaaatagaggaatacggtatttagttattgagtaccattgattaagccgtttcctccttatggctaagcccactcttatggtttgctgctacagtttcttccggtggactgtacagtccaccggggcagtccgtacagtccattgcagtggactgtacggagcgatgccggcgactatagtatgtaaccgtaagaatgggcttaaccataaggaagaaagagcttagtatcaggtatgaaagaccatacggtagcgtttcacaagctggaacacttactacactcttctgtccgtcacagtttcagcaaagatggaaacggaatcggtatagtacggattttagaaatcccccgtggctttcctcagcaagacaggagctctcgatatacttcagcatcttcttccgagaaacagcatacaatcacttctccttcatagccatgtgccatttcttccccgatggcattcaatgcgatacgtgccgcttcttccttgggataatgatatacgccggtactgatacaggggaatgcaatgctttggatgccgttttctctcgctagtataaaactggtacgataacatgatgcaagtttttcggcttctccatgcgttcccccatgccatacgggccctacagtatgaattactttcctgcatggcaggttgtatgcatcggttatcttgctttcccctgtcggacaaccgcccaatgttttgcattccgctaacaacgccggacctgcagcccgatggatagctccatctacaccgccaccacccagcaacgaactgttggctgcatttacaatggcgtcgacttttaaagtagtgatatcggctacggtaatatttatctttttcatttttcctttctgtttttctgtattaaaacctctatacaaagctatataataaattggggaattatgcagtttggcagcaaataaatcaattattctcctgttttgatatccttcccttttcattttgaaaagatcttcttttgctccctcttttttcttgttgttatatctgtatataaatcaattacttatctcctgtttgccagtaatggcacactattggcatatagcgtggcagttaacaatagtattaatttaaaaaaaggaattatggatttattttcaatcggatttgcggtttgtaccttgagcggcatagcttgcttttggcttttctttaaatgtatagactggttcgagaagatctaaaaaaagaaaggagaaacaagttatgtacacagcattatttgtagttagtttgattatgttcggctatatgatgtatgttcttatcaagccggagaagttttaaaaaagtaagttaagaaataaagagttatgaatactgaagttttaggtgttatagcgcaaattgtcttattgatagtgcttagctatcctttgggcaaatatatcgctaaagtttataaaggtgaaaagacttggtcggattttatgaagcccgttgaacgggttatgttcaaactgagtggtatcaatcccaatgaggagatgaactggaaacagtttttgagagccttgctggtggtaaatctattttggttcctttgggggatggtactgttggttacacaaggtgtgctgccgcttaacccggatggaaatgccggtcagactgcgcatcaggcatttaatacttgtatcagtttcatggtgaactgtaacttgcaacattatagcggtgaaagtgggctgacttattttactcagctattcgtcatcatgctctttcagtttattactgccgctaccggtatggctgccatggcaggtataatgaaagcgctggctgcaaagactactcagactattggcaatttctggaactatttggtattaagttgtacccgtgtcctgttgcctctttcattgatcgtaggttttatcctgattgtgcaaggcactccgatgggctttgacggaaaaatgaaggtgaccaccatggaaggaactacacaatatgtatcacaaggccctacggcggctattgtccctatcaaacaattgggtactaatgggggtggttattttggtgtaaactcttctcatcccttggagaaccctacctattttgctaatatggtggaatgttggtctatccttatcatacctatggcgatggcatttgcattcggtttctatctgaaacgtaaaaaattgggttatagtatatatggtgtcatgctgtttgcttatctggtaggagtttgtatcaatgtcagtcaggagatgggtggtaatccacgtattgatgagatggggatagcgcaggataatggcgcgatggaaggtaaagaaatacgtttgggctcggccgccactgctttgtggagtattactactacggttacttccaatggttctgtcaatggtatgcacgattcaacaatgccgctttcgggtatgatggaaatgctgaacatgcagatcaacacatggtttggcggtgtaggtgtgggatggatgaactactttacatttattattatcgccgtgttcatcagtgggttgatggtaggccgtacaccggagtttcttggtcataaagtagaagcacgtgaaatgaagattgcttccattgtagcactacttcatccgtttatcattttagttggtacagcattggctgcttatctgtttgttcatgcgcctgcatttgtggaaagtgaaggtggctggttgaacaatcccggatatcatggtctgagtgaaatgctttatgaatacacctcgtgtgccgccaataatggttccggttttgaaggactgggtgataacacatggttttggaactactcttgtggtattgtgctgatattaggacgttttgtcccgattgtaggtcaagtggccatagcaggtattctggctaagaaaaaatttattcccgaaagcgccggcacattgcaaaccgatacagtgacattcggtgtgatgacatttgcggttatttttattgttgccgcactatcattcttcccggtacatgcattaagcactattgccgagcacttgagtttataattctgataacagacaacgatattaatagaagatatgaaagataataaatcagcttctttatttcagaaggagcaagttattgacagcataaaacaatcattcgtgaagttgaatccgcgagtgatgattaagaatccgattatgttcacggtagaggtttgtacagctattatgttcttggtgatgctctactctatcgttaatgattcacaaggctcatttatttataatttatgggttttcgtaattctgttcatcaccttgttatttgctaattttgctgaagctattgccgaagcgcgcggaaaagcacaagccgatagcctgaggaagactcgtgaggagactcctgccaaattgattgtgaacgggactttgaaaactgtcagtagttcccagttaaagaaaggtgatatttttgtatgtgaggcaggagatgttattcctgccgatggcgagatcatcgaaggactggcgtctattgacgaaagtgccatcacaggcgaatccgctcctgtaatccgtgaagcaggcggtgacaagagttcagtaacaggaggtacaaaagtattgtccgatcagataaaagtaatggtaagcacccagccgggtgaaagtttcttggataagatgattgcattggtggaaggcgcatcccgccagaaaacaccgaatgaaattgcattgactatcctgttggcagcatttacattggtctttgtcattgtgtgtatcacccttaaaccgtttgccgattatacgggaactgtcattaccattgcttcttttctgtccttgtttgtctgcctcattcccaccactatcggaggattgctttcggctatcggtatcgccgggatggatcgtgctctgcgtgccaacgtcataaccaaatcgggtaaagcagtggaaacagccggagatatagatactttgcttcttgataaaacaggaacaataactataggaaaccgtaaagctactcgtttttatccggctcagggagtggatgaacatgctttcatcgaagcctgcctactctcatctgtatctgatgatactccggaaggtaaatctattattgaactgggacgtgaatcgggtttacggatgcgtaatttgaataccgatggtgctcatatgataaaatttaccgccgaaaccaaatgctcgggtattaacttgaaggatggaacagaaatccgtaaaggtgcatttgatgctatccgcaagatagctttgtctgccggaaaccctttcccaaaagaaacggaagatatcattcaaaccattacaagtaatggaggtactccattggtggtgagtgtcaataagaaaattgccggagttatagaattgcaggatatcataaaaccgggtattcaggaacgttttgaacgtttacgcaagatgggggtaaaaacagtcatggtgacgggagataaccctttgaccgccaaatatattgcagagaaagccggagtagacgacttcatagccgaagctaaaccggaggataagatggagtatatcaagaaagagcaggctgccggcaaactggttgccatgatgggtgacggaacaaatgatgctcctgcccttgcccaagctaatgtgggggttgccatgaatagcggtacacaggctgccaaggaagcagggaatatggtggatttggataatgatcctaccaagctgatagaaattgttgagataggtaaacaattgctgatgacacgtggtacactgaccactttctccatagccaatgatgtggccaaatattttgccattgttcctgcattgttcatgctttccattccagaactggctgcattgaatattatggggttgcatagccctgagagtgctatcttatctgcagttatattcaatgccatcattattcctattctgattccgctggcattgaaaggagttcaatacaaaccgataggagcttccgccttgcttcgtcgtaatcttttgatatatggcataggtggtgttattgctccttttgtgggtattaaattaatagatttagtagtaggattattcttttaacaagtaaataacaatgaaaaattttataaagtcattcagacttactttagtcttttgtgtgtttttctcagtatgctatatactagtcttatggattttcgctcaatttgccggacctaattccggcaatgccgagattgtggaacttaacggaaaagtggtaggtgcagccaatgtgggacaattatttacagaagatatctatttctggggacgtccttcatgtgctggtgaaggttatgatgcggctagttcggccggtagcaataaaggtcctaccaatgaggagtatctggctgaagtagaagctcggattgatacatttttaaagcatcatccttacttgagccgtaaggaagtacctgccgaaatggtaacagccagcggttccggattggatcctgacatcactccggcctgcgcatacgtgcaggtacaacgtgtggctaaagctcgcggaatgagtgaggaaactgtaaaagctattgtagataaagctgtggaaaaaccgtttatgggcatgttcggtacagagaaggtgaatgtgttaaaactgaatgctgctttagaaaaggcaaaataataaaaatatatagtcattaaattaggaagatgtgcgtcatgaaaaagagaagtttcctggataccgagagcctgtcggctctagaagctgtggctatcattgtattgttctttgctttgataacatggattcttgatctttgacgtgcatcaccattgaatgatgcatcttgattcagaaaaactcaaaatggatatttcctttcagacaataagaaggaaatagtagaaatatgtaaaacacgaatattaattagtttaattttttaagatgaaaaggaatttgaaaaaagtggtcttggtgctggctttactgttgcctggagtgataaaagcacaagaatttaacgtaacggctaaggcagattttgtaagtgattacatttggcgtggcgcttaccagaattcaggattttctgtacagcctacattaggattatcttacggcaacctttctttatctgcttgggggagtcagagcctgaccaagacagacggtgcacaagagtttgacatcaatttaagctatactattggcggtttaggtattacagtaaccgactattggtggaatggcatcaccatgccctacggggattataaacatgatcatcattttgaaggaacattagcttataatttcggcgagaactttcctctgaccttgagttggtctactatgtttgcgggaggagacgataacaaagacggtgatcgtgcttattccacttatatcaatgcttcttataatattgcttgcccggcagaaattacgctcactccttccgttggtttcactccttggaaaggaatgtatgatgctgatggtgctgcttttacagatattgctttaaaagcttccaagaacattaatattacagataatttttctttgcctttgtttgtacaggctattgtttcgccctcatttgacaaaacttatctgatagccggattaagtattgggttttaaatgtgtgatttttttgacaaaaaggagaaatgcaaagcatttctcctttttgttgtattagagtgacttatctttttttgattcttgccagatgtggtatttttgttcaaagagttgccacgtggagaatggaatatggcaaaaactaaagatagttttgtatctctttaatgttattcaacttaataaagtgggagtgcgttacttctccttcacattgttcgtgtgcccaagtgatatgatgaggtacataggctgcataacctccgagttccaatatgggaataatatctgactttattgagtttcctatcatcagtaaattttctgccttacaccctaaattatcaagcaatcttttataatccgcattcttcttgtcgctcattatttctatgtggcaaaaacattcttgtagtccggacgcagaaatctttcttttttgatcgaacagatcacctttggtggccaatactaatttataattttcgcacaaggctgatatgacttcttgcacaccgtccaataatatgattggcctttgcagaagttcctggcctgatcggaggatttcttttacgagattgagatctccttctccattagtaactttgcaaatggtttcaatcatgcaaagcagcattcctttcagtccataaccatagatatgcagattttttatttctgttttgaacagttcttctgatatggaaggagctggtaaatatttcctcagaagatgacaaaatttgtgttccaactcttgaaaataaagttcattttcccaaagagtgtcatcggcatcaaaagcgataaattctattttatttttcatgttttattattagaataggaagagggagcaatcatatcataatgtattgttttgtccgtcttttaagttctgtataaattcggcaacatttcgtccatccaccaagccatggtggacactgatggatatagggagcaaaagtttctttttttcttgtatcagcttacctgtagaaattttgggtatagaatctcctgtttgaattgaaccggcatgtttcatctcggaaaaggcaaaccaaggcagagccgaataacggatgacatctgctcttgcagtgtccttggaaaaagaaagtccggcactgttttttactctatgtatttccttttctgcattttcaataaataaggaaagatctgtgtcatactcaaaaaatccaaagccaaaagttccgtcctctcttccgatagtgggcgaaatattgattttatcatattctactacttctccgttttctatacgtaatttgaatgcagtagttgcattgatacatttcaataggaagtacacagaataaagaaaaaaagaaacctccatatttttactttgttgatatacgcttgtgaaatcaacagtcgtagtaattccccaaaaagggtcatcgagagccgagaagaatttaaaatgctcttttctattccaattgtccaggttaataactcgcttcattttctatttactctgtttttcttttatgtgtattatttctgttgcaactattttaacgataaaacatattgttgcaaatatacaaaaagtattttaacagagatgttctttgtttgctttaaatccattttattatttcctgttctgtgctaaagttaagaatggataacagcaactattttaaaaggttattcaggactgataatcaactatatgtctatttttgtttataagggaaagaattctattaaattcataagtcagatttttgtatggataacaatttaggtgatagaattggcaataaagtacaaatcgctataaggataaaataatgttttatttaatcaaaaacaaaagcaacaaataccttgtcggacgaattgttgcttctgtttactcaggaaggtcacataacaaaagagtcttgtaattgagtttgctttattacatcaaatttctctgatggaatatctagaaaggctttgcacagtgtcactaatgccttttctctatcttgttcccgtaccagcactgaaagattgtgagtgctgctaccgtatgaaatcatgcataccggcatttctttcagtgtttctataattctggcttccaaccctgtatgcttttcccaatttagatctccaataacgctgaccacagacatttctgtttccattcctatttccgcatacttatgtaattcacgatatatcaggcgtaatgtgtcgttgctacatttcacagccaatgaaacacttacattagaggaagtcgctaaatagacaggaaccttatatttctcgaacacatcaaatacttttccaataaatagataagaagtaagaatccccaacgaacgaagtttgacaaagaccacacctctgcgtgaaacagcagcttttacttttgttcctgttttttctgatgatattcgtaatgtatctttcggtgtttttatcaatacaatagccataccggcggtgcgcgccagcggaatacattccggatgaagcaatgcaatgccgctatcaataaaattctcggcttcaccgtatgtaagagttcgagtatgttccatacctcggaaacaaatttcatcagaatgtaaggatgttataatttcatccgcatggaatacagccccgataacagtggcataatactcatttcctatttgtgggaagaaatccacttcatcatatacatttttacacaaacggctttgggtaataagaatgtgaacatcgggacagtctttcatcagttcttctacattctttttcacatactttatatccggttttcgatcaagccctagtcgcatgaaatgacatgagttcaagatgaagttcttttttgtacattcttctaaataatgtgacagaataagagaggatatcattgctccgtgagccatgatctcatgatcgtcaatgatgttcagattttcattacataaacgggaaatttgatcgatgtgtacttttatttctttggcagcttctgctttctgtatttcggaggaaagaagattgtccagccaatttctacaatcattctcaaaatcctgcaattgactcataacctcttcgatatcgacatggaataaagaaatagaaacagcttgcagcttttgggcaatgctggtaaaagtgtcgagcactataatagaacgttcgttcatgttaattacttcagtccaatgtttcagttcggtggcagatttaatattttctaaattatatactttcatttttttattgcattttattcttttggagtttctttttcattttaacaggcaaatttccatattggaaagctatgtttttactagtttcatctttattagtttgttaatcagttatttcttattgtttgctcgctaccttttctataagttgatagcgttatactccatataaatcaaaatcgatgccattacaaaaattgcacttttatctttcagctatttcatttcccattttagaaaaaaggctttcatattgaaaaagtataaactaatcaataaacatatatcatgttgataataagatgtttaaattagtggtatgacttttgtcatctaattgaaaaaaagaattatataaaaatgaaattgtatatcatatcaaacagactgcccgtgaaggctgtcgcagaaaaagatacctttgttttctcacgtagtgaaggaggtctgacaacgggactaaattccctacagggcaattacgagaaacattgggtggggtggcccggaatctgtacagacaaagaggaagaaaaacaggatatctgtcaccggttggaggaaatgaatctccatcccatatttttatccgatgagcaatataagaactattatgagggatacagtaacagtaccctgtggcctttatgtcactatttctttgcctatacattatatagaaaaagtttctggcaatcttaccaagaggttaacgctttgttttgtcgggaaattatccgccttgtggaaccggatgattgggtctgggtacaagattatcagttgatgttacttccggaaatgcttcgccaagagcttccccagttgcatatcggttatttccatcatattccgtttccatcttatgagttattccgaattctacctgaacgtgccgaaatactgaaaggattgttaggagccgattttatcgcatttcatacacatgactatatgcgtcatttcatcagtgcggccgaacgggtactccatatagatttcagtttggatgaaacccggataggcagtcgcattgtgcgcgttgatgcacttccgatggggataaattatgacctttaccacaatgtgtcacaacaaaaaaatgtttggaaggctatagaacgaacccgtctcttgtttggcaaacataaacttatcctatcggtagaccgtttggattatagtaaaggtattttgcaccgcctttatggatttgcctcttttttggaacaccatcccgaatatcatggcaaggtaacactggctatggtcatagttccttcacgtgatcatgtaggcagttatgccgaattgaaaacccggattgacgaggaaataggttctatcaacggacgatattctacaatgaactggactccggtctgctatttttatcatggtttttcattcgaagaattggctgctatgtattttatagctgatattgcattagtaactcctttgcgtgacggaatgaacttggttgccaaagagtatgttgctgtcaagcaagacaatcccggtgtattggttttaagtgaaatggccggtgccgctgtggaactgaccgacgccttgctggttaatcccaatgatacggagcagatagaaaatgccatttgccgggcattggaaatgccgtttgaagaacagcaagaacggatgcaccgtatgcagtctattgtatccgtacagactgtcaataaatgggctgccgattttgtaaatgaatggcaggaagtggcacacaaaaacaaaaccatgctttttaagaagataggatcacagaatatgcaggaaattcagcatcaatacttacatgctaaaaagcgtttgattttgttggattatgacgggacactggtcccttttcagaaaaggccggaagatgcctctcctactccacaattgctggatatattgcagaaactgaccgccgaccccttgaatcatgtggtaataaacagcggacgtgaccattttactttagagaagtggttgggtgcactgcctctttcctttgcagccgaacatggggccttttataaagagaatggtgtatggcacaagaatgtacacgggcaggaatggagccccggattgctttctatattaaaattatttgtcagcaagactcctcgctcccatcttgaagtcaaagaaacggcacttgcctggcattatcgtgaagccgatgcatggttgggaagattacgtgcgcaacagttggtcaattccttgatatctatttgcttgaaacagaatttgcaaatcatgcagggtaataaggtaatagaaataaaatctcccgaatttaccaaaggttcagaagtaaacaggcttttgcttgccacccgatatgattttatcttggcaataggagatgatactacggatgatgatatgtttaaagccgtacctgttactgctgtgactgtaaagattggtacagcatccgagagtgcacgttacaatctgcccgtacagacagacaccttgccgtttttacaacggctgacagatgaaggcatggtgaaagcagccttgaaaagtggtttgaaagggcagttatcatcggctatagatttttttaaacggataataaaccactaacattacaaaaaaaataaccatggataatttgaattacggtgtaatcggtaattgctgcacagccgcactgatttccgaaaaaggaagtattgaatggctatgttttccaaattttgattcaccttctatttttgcagctcttctagatcgtgaaaaaggcgggacttttggttttgaagtttcagaagactatcacaccatccaatcgtatgttccccataccaatattctttccactacttttgtgtcagaacaagacgaatttgcggtagtcgactttatgccttgttatgagttatatgataataaggaatattatcgtccagctgaggtctatcgttatatccgctggattaaaggtcgtcctcgcattaaagtcaattaccatccggctcccgattatgctcgtggaaaagcgttttttaatgtaacttcccggtatattgaaacctattcttcttctaacaacaaggacagacaatatctgtattcctctttgccgttgcaaggtattgtaaaccatcaggaatttatattagagaaagatgaattttttcttctttcatacaatgaaaaggtgattcctgttgatatagagcgtgagaaactggagtattgccgcacgttggtttattggttgaactggacggatcgtacaagaaagttcactatttacaacgatataatagagcgtagcttactcaccctgaagatgatgtccttttataatggcgcggtattagcctctcttactaccagcctgcccgaagctgtgggagaagtacgcaattgggattaccgtttttgttggttgcgagatgcctccatgtccatagagacccttttcaaaataggtcatgccgatgcagcccgcaaattcatgaaattcatacaatctacttttgttgccgagcatgacacttatcaaataatgtatggcattcgtggggaaaggaaattgactgaagttatactcgaccatctttcaggatataaaaactccaaaccggtgcgtatcggcaatgatgcttatcatcaaaggcagaatgattcgttcggctatttgatggatttgatttaccaatattaccggttgatgccaggtacattggatgaaatagaagatatgtgggaaatggtgaaaagcattatgatgactgtggtggaagattggagaaagcctgataaaggaatttgggagatacggggtgaaggacagcatttcgtttcgtccaaagtgatgtgttgggttgctttggacagaggagcccgcatagctcgtattctgaataaatatgagaatagccgacgttgggaagaagaagctgatgcaattaaagctgatgttatgagaaacggctggaaggaagaaatacaaagtttttcacaagcatacggcaatctggatttggattcttctttactgttaatggaaccttatggatttatagatgctgatgatattcgttatcataaaacagtgaaagccgtcaagaaatccctgttacacaaagggttgatgtaccgttataatactcatgatgattttggctgtccttcttcggcctttaccatctgtactttttggctgatccgtgcactttatgtcatcggggaaaaagacgaagcacgctgtttgttcgatgaaattttgcaatattcaaaccatttgggtctgttcagtgaagatattgatttcgaaacaaaagaacaactgggtaattttccacaagcttattctcatctggcactggtaaatactgctgtgttatttgcggaagaagataaaaggctaatctttaaataaggaaaaatttggagaaggactgataatccagtatctttgtacaattaaaatcaggaaaatgcgtataacaaaaaaacggagccaaaggttaatcttgcagtctttagtaaaaaacggatgtccatatattattatatgtatatggtgtgtgttgtctggcggatgtgttcagaataaatcccaagattcattgaaaacattaaaaacagaaattcgacatattattaaagataagaaagcaactataggagtggctttgatactggatggagaagatacgctggccataaataatgccgaaaaatatcccatgatgagcgtttataagtttcatcaggcattggctgtatgtgattacctgcaaaaacggcatattccactttccacttccctatatcttgataaaaggtatttcaaaccggatacatacagccctttgcgtgataaatatccccaaggtaatttggaacttccgattagtgaacttttagcttatacaatgcagttaagtgacaatgtagcctgtgatattttattcgattatataggtggtgtaaacgtggtggatgaatacattcattcattgggaataaacgatgtttctataactactaccgaagatgagatgcatcaagacatggatgattgttacaaaaactggacaacaccaatggaagcagccaatctattggaactttttatgactcaagattccatgaaaaatgaatatacaaattttctaaaacatattatgatagagtgtgagacaggtaaagacagactacctgctccccttcccgaaagtgaagtcaagataggacataagacaggaacttccgataagaatgaacggggggaatacattggcatcaatgacattggttttgtaattctacctgatgggaaccgatacgtagtagccgtatttgtcaaagactcaaaagaaaatatggaaacgaatactaagatcatctctgatatttcggctgctatttaccgatatgccaggaatcgttaaaatagtgctattttgtactgtctatgaaaataaagacaagaatgtcataaatataatattatggattatcacatcgttaaaatatctagaaataaaaagcaatatctggatttattattgcttggggatgaacaggaaataatggtagaccgatatttggagcgcggtgacttgtttgtattggaagataacgggataaaagctgtttgtgttgtaacaaaagaaggtccgaaaatttgtgaattgaagaatatagcggttacccctagtgcccaacgacaaggatatggtagaaaactaataaattacctgataaaccattactcaaaagaatatactcagatgatggtgggaacgggagacgttcctggcactcttgcattttataaaagttgcggttttgaatattctcattgtataaaagattttttcacggagaattacgatcatcctatcattgacaatggggttttactaaaagatatgatttatttgaaacgtaaaatagggttttaaaagagtggaaacgatcaaatccttactaaatttaaacattattttctatcactttcaatgaatcggacagaagaataattctttttatgaataatctatttacaattcaataaaataaatgtatctttgcaatatgttaaaaactcatatatcggatttggtgtcgtaaacaatctgtttttatagaatagattgtccagtcgtttttactctcagaatgtcttttgagagcaattttatattatttataattgatcttttaatccgcatacaaataatgggattgtatgcctcaatgttttacaataatgaataacgataataatcataatacaatccaagagttcgacgtaaatttaatctgtgatttctttttaaatacaaaccggcaaggtcccggaagtcccgaagcaaccttaaaagcactaagctttataaataatctcactgttcaatcccttatcgccgatctcggttgtgggacaggaggtcagacaatggtattggcacaacatacaccgggaagtattacaggactcgacttctttccggaatttattgaatgcttcaacaggaatgccgaaaagttaaatttacaagatagagtaaaaggtgtagtcggctcaatggatgccctttcttttgaaaaagaatccctagacttgatttggtcggaaggagctatttataatatcggttttgaacgaggattgaacgagtggcgcaattatttgaaaccgggaggataccttgccgtttctgaaagtgtctggtttaccgatcaccgtccggcagagattcatgatttctggatgaatgcttacacggaaatagatacaattcctaataaaatagtacaaatacaaaaagcgggatatattcccgttgctacgttcattcttccggagaattgctggacagaacattattatgttccgcaggccaaagccaaagaaatgtttatcaagaagtatgcagggaataaaacagctgaaaaactgatggcatccatctgccatgaagctgaattatatagtaagtataaagaatactatggatatgcattttttatagcaaagaaaataaatccctttcaaggttagtggaaagaagagtaaagtgaccttctaaaacatattcaagtagtgcagacattctgttcaaggagtatctgcactcgcttttttatatatcaagtatttccattaaagcgcttttcagtacataggcacttatacccagtcgtctttttcaccgcctcattcagataaacagatgagacattgagcagcaaagcatattcttgtgggcgttttaatgaatggaattttacagcctataaggctttaaattgttttatgataatagttttaattaccctctttttaaaacgttttctaattgacaaagtaattcattttcaatcagaaaaccgaattgataaagaatcatatcttgttgaacttagtcttccattcctaatattttcttcatttgcggtcggaatccatctccccatttttctaattgttcaataatgggaagcagtgttctaccttgctctgtaatggaatattctgtatggggaggaagttccgaaaaaatctttttctgtatcatgccatgaatctccagttctttcagttgttggttgattacccttgggctggcatcatcaaagtaacgatgaagttcactcgggcgcttcgggcctttgtccaattcttgaataatgcagcttttccattttccaccaatcacttccatcgctattttcacaccgcagtctatatcaaaaggtattttctttctgtacataaatcttcttttttctgcaaaattaatcatattgaaataacatggaaagaatagcttctactcttttcatgttatagggataaattattcatatactgattaatttatccctacttgcgcaaaccatcgggtaattataaatttgcagacagattcagatataggaataatgggatatataataatgatataatgaaaaagtggttatctctgataatattactggctgttaatgtgatttctattaatgcacaacagaaaaattcaattaataatcaaagtatggaaaagaaaacaaaaacaattcgtttgatttatccgcaatggcaaggaggtgatattgctcggtggattactgaaataaaagatcccgaagcagcatcaaagggatacttcttaggggcagaattgcttaacttcttggctcccgacagcagtcaagaaacactgacagttcccatttcaacagaaattacagaacgtagaaaaaaggacggtgtactagaccgcgacattattgtgaaacagactaaagctgctcttgacttgttgcgtatcagtgatcctgataaaatagtaactcttggaggagaatgttctgtcagtgtcgttccgtttacctaccttgcagagaaatataaagatgatgtggcaatgatttggattgatgcccatcctgatataacacttcccggagatatgtacagcggattccatgccatggctgttactgcctgcatggggaaaggcgacaaggaaatcctttccaagctaccggcccaaatagccccctcaaagattctgctcgtaggattgcgtgattgggaacgtgatgaaataaaagtccgccagaaacaatatggtataaaacatcttactccggaagatgtagcacaaaatagtaatgctatatatgaatggttaaaatcatgtggagcatcccgcgtgttaattcattttgatatggatgtgctcgaccctgccgaaattatagcagccgtaggggtagttcccgatggaatgaaattggcagaagtggtccgcgttattaatgatattgccaaagaaaaagaaatagtaggtctaaccgttgccgaaccgatgccacggattgctatcagaattaaagaaatgttaaatcaattacctttgttgaaatgataaggaacagataaaaagacatttagaataacctgtcaaaatcaattctccggagaactccaatattttatgggcaaagtggttctagattactttatcctttaagccaaaaaacattttcagagagggcaaaatcctccctgaaaatgtatttgggtgattgaactatgaatgagaatataaagcaaaatacttccaaagcggtgctgccatcaatgattgttttacttcatcattcaataacaacgcttttatttcttcttcactcagcaaatgcactgtcaaatcttcagtttcttccaaatgctgggtggagattcgttctacctccgtagccagataacaatgagtgatatttgtcatggtgctggcatttgcagagacggtcataagttttgtccaatttccattaccataccctgtttcttcgtacaattcgcgttgggcagaaagcaaaggttcttctccggtttcacaaactccggcacaaatttcataacgtgtttcttttattccgtgacggtattggcgtactaatacgaatttaccctctttggtgatagcaattacatttacccaatcaggatattccaaaatataatattcaggaatttcaactcctgtaggtaatttaacccgatcacggcgtgcggtcagccaagggcggcggataagatattcactttcaataatctcccattttctatcgtctgtgttcatataataagttttttgttttatactctacattataaaatttattcttgttagtggcttaattgattatatcggcaaaggtacattaatccatttgcattaactataacactcccattctttttgaagaaattcaggaatgaattatgtaaatgatgaaaagactttagctaactttgcagacaataataaaatgataaattttattcaaacagaatggaaaatagaataagtccggagtcttctctatggaatccttggcatggctgccataagctaagtacaggttgccggcattgttatgtatatcgcggagatagtaaacatgggaaagacagttccataataactaaaaccggacaattcaatctgcccgtgaggcggaaaaaggataagacttacaagatcccttccggaaatctcgtctatacttgttttacctctgattttctgatagaagaagccgatgaatggcgtatagaagcatggaaaatgatgcgggaacgatacgatcttcatttcttgtttataactaaacgtatagaccggctcagccaatgtctgcctccggattggggggacgggtatgataatgttaccatttgttgcaccatggaaaatcaagaaagagtggattaccgtcttcctctttataaagcagctcctgtaaagcataaaatcattatctgtgaaccattgttgtccgctataaacttcaagggagaacttggtatatgggtagaacagattgtggtaggtggagaatcaggtaaagaagcgcgcatatgtaattatgactgggtgttggacattcgtcggcaatgtatagaaaataatattagcttttggtttaaacaaactggatacagattactaaaaggagaacgtgaatataaaatagcccgccaatttcaacatacacaagctagaaaagcaggaataaactattctaggggatctaacagcaataattatagtgattaagaaagtgtttcattttgaaagagttccttttcattttggtaagctttagtttttaatgacacgcttatggcattgtaactaagccgtttgttttattggtatattctttgtctgttataaaaggactgatattaaatatgcggaaaattgttatatttacactaatatgataaagtaacaaatggaagacagagaagaaagtgtacagcattttttagatttgattaaacgttcacggcgtggaaagtttaaaatctatatcggaatgatagccggtgtagggaagagttatcgtatgctgcaagaagctcacgaaatgttggagaacggggtagatgtacagataggttatattgaaacgcacggacgtgcaggaaccgttgctatgttggaaggattgcctgttatctctcggaaaaagatattttacaaaggtaaggaagtggaagaaatggatcttgatgccattcttcagttacatcccgaactagttatagtagatgaattggcacataccaatatcgagggcagccggaatgagaaacgttggcaagatgtaatggaattgttggatgccggtataaacgtaatttctgcagttaacatccagcatatagaaagtttgaatgaggacgtaaaaggtatagcaggtatagaagttaaagaacggattccggataaggtgctgcaggatgcggatgaagtggtaaatatagaccttaccgccgaagaactgataaaccggttgaaagccgggaaaatctatcgtcctgaaaagattcagttggcactgaataatttttttaagacagagaatattcttcagttacgtgaactggcactaaaagaagtggcctttcgagtcgagaagaaagttgaaaatgaaattgtaacaggtgaaaagggcatccggcacgagaagtttttggcatgtatcagtagtaatgaacggactccccgacatattatccgtaaagcggcacggcttgcttcccggtacaatacggtcttttttgccctctatgtacagacacctgccgagagtacggaacgtattccattggcaacacagcggcatttacttaaccattttaaactggttaccgagttaggcggtgaaattatccaagtttcatcttccgatattatgggagaaataattaaaacttgtcgtcaacgtggaattacaaccgtctgtatggggcatcctactttcaaaatgccaggtgcattattcagtctttccaaatatcgaaaatttctaaactctttagctgaaatagacatagatttgattatacttgcataaaaaataaaagttatgaatataaagtcgaaactaacccttgccataggggtattggtggcaatgattgtactattggttgtactttctgttgtgaatttgcaaatattgaccgccacggaacctgacagtccggcagcaggtcccggattacagcgggctttattgtggatatatgttgttggtgccgcatgtatatgtattggtattggtatgtggctgcgtcttcctgcatcgattgataatcctattaaagaattgaccaacgctatacaggaaattgcgaaccataattataaaaaacgtttggaattaagcaatagtgaagaattttctgaagtatctaaaaatttcaaccgcatggccaaacgtctggaagattatcatgcaagtgctttatccgatatgatggcatctaaaaaatatatggagactatcatcaacagtatcaacgagcctatcattggtttaaataatgatatggaaatccttttcatcaatgatgaagcattgaatgtgatcaacctgaagcgtgaagaagttattaaacactctgcacaggatatttccctgcgcaatgatttgttgcgtcgcctgattcgtgaattggtggaaattcctggggaaccagtcagagacaaggaaaaagaaaagaaagaacctctgaagatttatgcggacaataaagagagttttttccaagtaaaatacatgagtatttcccaaccggggaaagatggggttactatggaaaaaaaaggatatgtcattatgttgaagaatataaccgaatttaaggaactggattcggccaagactacgtttatctctacaatctcacatgaattgaagactcctatctcggctattatgatgagtctgcaattattagaagaccagcgtatcggagctttaaatgaagaacaggaagatttggcaaacagtatcaaagaaaatagcgaacggctgcttaatatcaccggcgagttgctgaatatgacccaggtagaatcaggaaaactacagttgaagcctaagataaccaaacctatagagttgatagaatatgcaataaaggccaatcgtgtacaagctgaaaaatttaatattcaaatagaagtggaataccctgaagacaaaataggtaaactgtttgtcgacagtgagaagatagcttgggttctaaccaaccttctttccaatgccatccggtattcaccggaaaacggtcgtgtggtaataggggcacgtcaaacagatgatggattcattgagatgtttgtacgggatttcgggaaagggattgatccacgttatcataaaagcatctttgaccattatttccgggttcccggaactaaagtacaaggaagcggtttaggcctgtctatttcccgagattttgtcgaggcccataatggtactcttacagtagacagtaagctgggagaaggaagtatgtttgttatgcgattaaaagcatgatcacagcacaggggagagaatctttcaataagagctctcccccgctgcttttgaaccaagccggaaaagcttactccaacctgtgaacggtaatatcgctaaaatcttgtaataatgtcagtaacataccttcatcattgtatttcttagattttataaccattgtaacataataggttgttacttctcccaacctcttttcgtccaattgataggaaacaatattgtattccttggaattgaatttcttggccatacggttcagtgtttctttattgtctgtagagaactctaccatggaacttttcatacctatacttttaaaaagatagctaagtgcctcaagaccaatcagcgtaaggattgttgctgagattcccagccagtacataccggctccaatggccagaccgatgcccgaagtagcccaaattccggcagcggtagtaagtccgcgcacgatttgtttttgaaaaataatagtacccgctccaataaaaccgataccactgacaacctgtgcggccacacgactcgggtccaagtctatcccctccatcttcactacttccataaaaccatattgtgatacaatcataatgagagcacttcccagtgatactagaaaatgggtacggtaaccggcttctttagcacgatattccctatccagaccaataacagtacccaaagcgcctgccacaaacaatctcaaaataaaatcccacgtcatgctcatattgaaatcctccttttattcatcgtcttcatcatcagtcagttcgggcaaactcaacattcgttggctgtcttctgccggaagggcttctacctggcgtaatttacgttctatggcacgagtacgtttccccataacttcctctaactggtctcctgcattctgtagatttttctgtaccttttccagcaatcctccaaactttccgaattcggtctttactgcccctaacacattccatacttcgcttgttcgtttttgaatggccagcgtacggaatcccatttgcaaactattcaggatagctcccagggtggtaggacctgtaaccactatcttccagtctttctgcaacatttccaccaacgcggtccggcggatcacttctgcatagatgttttcgaatggcagaaacataatggcaaaatctgttgtaaaaggtgggtctacatatttatcgtgaatatcctttgccatttttttaattgtgatttccagttgacgggatgaagtttcaatcaatgcggcatctccggcttcgtatgcatcctgatattgttcatatacatctttgggaaatttggcatccacaggtaaatatacagtatcattattattttcctttcccggaagtttaatggcgaactccacaaattccgttgcatttttcttggttttgacattcgcctcatattgttccggactcagcatctgatccaataaggcacctaattgtacttctccgaatgtaccccgtgtcttcacattacttaaaacttttttcaatcctcctacatcctgtgccagacccttcatctctcccaatcctttttgtacattctccagctgcgaacgtactatctcaaaggattgtcctatacgttcattcaatgttttctgtaatttttcttctaccatttgccgcatgtcatccaatcgtttttccgtacttttcaccaaagcttcctgttgcttgcccattgcttcaaatttttcccgttgcatttcattaccggtcagcaggtttttatgcaaagtatcctgcatattacggatagaataattcaaggtttgattcagttcgttacgaagttcgcgaatattttttcccagttcgtcccggttttctttcatttcttcgcgtagcaatccttccagacgttcggtttgcagacgattgtttttagtaagtgcgattacaatattaattatcagcaggataataattacggttaataaaatttctgtcatgattcttgtttattttgagcaaatgtagcaaaaagccatgaatttaatcgttatatttgcagcgaatttggcaaaagcactccattaaatagtatatgaagtataaattattagttttagacctagacggaacgttgaccaataaaaagaaagaggtaacggaacacacacgtcgtacacttatcgaagcgcaaaagcgcggagtaaaaattgttttggcatcgggacgtcccacatacggtgtggctccactggctgagatcttagagctgcagaaatacgaaggttatatactttcgtataacggaggtgagatcatagactggaaaaccggtgagatgatgtacgagaatgtgctcgatccggatatattaccttacctgtataaatgtgccaccgacaaccattttgctatcgtcacttacgatggaaaatatgtattgactgaatatccggaagatgaatatgtattgaaagaagctattttgaatgtgatgactcccaagaaagtggatcattttctggaggcaataaaatttcctattgccaaatgtctgattgtaggtgaacctacgcggcttgcagtgcttgaaaaagaaatgtacgaacatttgaaagatcgtatgggggtattccgttccgaaccttattttttggaattggttcctaaaggtattgataaagcacaatcactggccgtattgctaaaagaaatcggtatgacaaaagaagaaatgattgccgttggtgatggttttaacgatctttctatgatacaatatgccggattgggggtagcaatggccaatgctcaagaaatagtccgtcaaaacgccgactacatcaccctttctaatgaagaagatggtgtagccgcggtagtagagaaatttattctttaggtttccggtcaaagaaaggatttttagaggatgcgctgacagggatggcataaacctgggtgcatccttccagccagttcagacgctgtgctgctaatccggccgagaacatgacccgtgtgtccaccctgttgtctgctgctgtggcacaagctgatccgatagcaatgcccacatcaacactattgatagcacatggcactccttctttgcgagacacacaagtggcatatccacaatgaccacaattcaatccttgcgcctgttcgtgtgtacctattaacaggacacattctgcattcagaatattttccgcatcgcgcaggaagaatttcattccatgctccgcaaccattttcaccatcatttccgataaaatattgatattaccatccgtcaccatggctatttcaataatatcaacaccttttcctttgggagcagtacgcgctgctgtcatcatttgtcgggccacatgcagaacatgttcatggcggctttctctttcattcaatatcatataaatcttagttataagttagctattaatacaaaattagtgaatatgaatgatataaggctcttgctttaagcctaaaaagtataaaaagagtcaccggttaaaaaaatatcaaaataaaaagagaaatatagtggataatccaattatttatcgttcctttgacaacggaatataaaaagatagttttttcgattgactcaattcatctcacacttgaaccgtttctattcttctaactaaatttttaaattcaaagtttacttaattatttatttatcaatttttattttatgaatttgtatattggaaaccttaactataatgttagggaaggtgatttgagaggtgtaatggaagagtatggaacagtagcttcagtaaaacttattactgatcgtgaaacacgtcgttctaaaggttttgcttttgtagaaatgcctaatgatggcgaagctaaagaagctatcaagcaattgaacggtgcagaatatgtaaaccgtactatggttgtaaaagaagcacttcctaaagcataaggaattagacattccatgtcacatgatggcgatagagtgaatctctatcgctatttttttcttgaacagctttctagtttgaaaatacatgaaagggttattgataaggaaacggacatctgttttgtcagaatgtccgtttcttgtttagtatttgttctttagaaagctattgctccgaaggcgaatttactccactcctatttcgtcaacaaacagaaaagctttttcgccaggcatggaatgccatgcgggaagtttcggagtaacttctgctatgattttaatatagcgggcttttactttatcaaaggaaacagagtctttgcggctttgcattttagttcctttttccacaacgggaaaattttcggaggctaccctgcggaaatttttcccatcctcagaaacttccaccttcagacctgttgcaccaaagatagcatcgcctgtgttcaacattgtgtttacaaaaactgaagatacttccttaggctcaagtaaatcaagggtcacattcatatctgtcccgtagaaaccaatccaacgtcctgagcgataattcatatccccatataatccgtctatcaaggtacttcctcctttaaaagtatatgatttatgaggaatggtattcaaggtaaccggtctcattgtggctgcattaaaatgtatttcctccttacttatctgactagtaccctgcggacgaactgcaatggcttgtatgataacatctttatccacttgtatagtgtcggtatacaatggggattgcacatcgggaacgctgccatccaatgtataatgtatttccgcatcatcaaaagtctgaaaagcaatcttggcttttccttcatcgggagccggaacgatatcaatgttcacatcataaatatcctgacgaaaatcataacctctatcccggtaaatagccagcagagctggtaaacgtttcaaaaaactgtcgaaatttttatgtaacggttccgtccattgaatctcggacaaggcagccatacgaggaagaatttgccattccatcttcaaactgtcacgcgtccattctgtccagatacatccttgagtaccgatgatatattttcgttcatcctctgccaattcattagaaacaggttcaaatgtatagacacgttcaaggcttttagtcccttttatccgattgtaagtaggattgctgaaataaagaaactgaataggagtcataattgcatcatggtgcagacgggcggcttcgataccacctttgacaccagtccatgacatcactgtggcacctggagccaatcctccctccaacatctcatcccagcccagcattttacgccctctgtcattaataactttgcctacctcggacatgaaataggtctgtaattgattctccttgctgtgttttggtgtatctttcaaacccagttcccgaattttagcttgacatgcagggcatttttcccaacgtactttcggacattcatccccaccaatatggatataaggagatggaaagatgtccataatttcattcaatacatctttagcaaactgtaaagcccggtcgtttcctccacaaagcacatcagggaataccccccatttacaaggaatctcgtatggacctcccgtacaacctaattccggataggaaaccaaagctcccatcatatgtcccggaaggtcaacttcgggaattacagtaataaaacggtcagcggcatacttgacaatctcttttgcttcttcctgtgtataaaaaccgctatgaggagtttcatcataggtctgggtttcacggtcaatcaacgtacgtggacgtatcgaacctatttccgtaagtttgggatatttcttgatttcaattctccaaccttggtcttcagtcagatgccaatgaaaataattgatattgtgcaatgccagcatatcaatgatttgtttcagataagaaaccgggaaataatggcggcccacgtctaccataaaaccgcgataaccgaaacgaggatagtcattaacagttcccaccgggatggcagcggatacctgtttgtttttggtcaatggcaaagccttatagagcgtttgcattccataaaagaccccagactcacttcctccattcaaatgaatgttttcagaagttacctccagttgatacccctctttgttggtaatggaactgtcaaccgccaagattatggaattcttctttgcggcttcagttgttgtccggacggtaattcccgtagcctctttaatataggaagctaaaaattctgccgtccgttgcaacttttcattgccttccggatagacaataccggtttgcggattaataacaaaagggtgggcttgaatgtcttgacttacttcttggggctgcggaatgacattcaggtttccgatttctgtttttgtaggagaacatgcggacagaccaaataccatccacattcccactcctgcccattgcatcagttgttttttcatagtggaaaatttataattacaagggcaaagatacaaaatctgatcttatttgccagtatgccttaaccgaatcttgctttttttcagcaatgtttttcctcctataattagagttacggcagtaatcaccatcaaaatgcccagaataatgcgcggtgtcagctgctctccaaaaatcagtactccgaagaataaagctgtaacaggctccaaagcacctagaatagcagtgggtgtggagccaatgtagtgtatggcctttgtcatagtcaccaacgaaataacagtaggaaaaacagccagtgaaattgcgtttacccataacaagggtgtagggataagctgcaatcccgtacagaacttcaatcgcaccacataaacagacagaccgaaaagcaggacatagaaagtaagcttggctataggcatatccttcagggaagaacggtttacaccaactatatagatagcataagctaaggatgataaaaagacaaaagtaatcccgaccaagctgagtgtctgtcctcccggacttttacaaagcaaggaaattcccacaaaggccagcgctatggaaaacatagtgaccggcgatactttttccttaaatactacagccataataatagctaccagtaccgggtagacaaacaatatggtggatgcgataccggcatccatgtagttataactcataaagagaaacagggaagagaatgagaacagcaaccccatgatgcaaagtggcagcacatccgctttcttaatggcaaaagattgtttctgcatcttcatcatgatacctagtacaactatagccagtgcatagcgataaaataataccgagtctacgctcattcctgcactataaagaggaagggtgaacagtgggttcatgccgtagctggctgctgcgattgccccaaggagaaatcctttagtcttgttgttaatcatcgtttttattacacgctttaaaatcggcgcgaaattagatatttgttagcaataaacaaaggaaaagtgctttattctttcaatctaacatctatttatttagattatacctaatcaacaaatataaaagaatttatatcacctgtagctgctgaaaaaattatatgaaatgaacggacacggacagagagggaaaatgcaggtttgttcttctgtccgtgttctatattgatcagctcagtttatgaataaccaatcccgaacgaagtttcggttcaaaccaagttgttttgggcggcataatattaccggtatcggcaatatccattaattgtttcatagaaacaggataaagggccaaagccactttcatttcaccgctgtccacacgcttctttaattcctccaagccacggataccacctacaaagtcaatccgtttgtcggaacgaagatccttgattcccaatatttcatccaatatcaagttggaagaaatagtcacgtctaatactccgataggatcattgtcatcgtatgtgcccggttttgctgtcaagctgtaccatttaccgtccagatagagagagaaattgtgaagagcctgcggtttataaacctcaatacctttctcttctactacaaaattcttgctgacagcggtcaggaattgttccggagacagcccgttcaagtcttttacaacacgattgtaatcaataatagtcagctggttggccgggaaacatacagccataaagtaattgtattcctcatttccctgatggtttgcattttgctgcgctttttcggcacctaccaaggcggcagcagccgagcgatgatggccatcggcaatataaagagccggcatagctttgaaagcttttgtgatagctgttatatcttcttctttgtcgatcacccagaatgaatgtccgaaaccgtcacccggagcgataaaatcatattccggctgttgtgaagtatatttcttaacgatagcatctaattccgcattatccgggtaagcaaagaataccggttctatattggcattatttacgcggacatgtttcatgcggtcttcctccttatcacgacgggtcagttcatgttttttgatgaccccgttcatataatcgggaacatacgctcctaccaccaacccatattgggttttgccattcatggtttgtgcatatacataataattttcttttccgtcttgcaccaaccagcccttgtcctgaaacatctggaaattttcggcagccttctcatatactttaggatcgtgttcgtctgttccggcagggaaatcaatttccggtttaataatatgataaagtgacttttcattacctttcgcttcctcacgtgcttcttcagaattcagtacgtcgtatgggcgtgaagctacttgttctaccaattctttcggagggcggatgcctttgaagggttttattattgccataaaaataaaggtattagattttacttgcaggagcgaattgcattcgcccgaaaacataagctatatgcattcggtcggattcaatccgcccctgcggttattggattacttatttactctgaacttttcacaaccatctttcaggaagcctacaatttgtctggcggcagcaatacctgcgttgatatttgcttcagccgtctgggctcccatctttttcggtgtagagaaatagcggccggcaaatttttctgagaactcagcatgggcaaccggcatgatatcagtaacatactttaagtcggttcgttcttccatcagtttgattaattccgcttcattgatcacttccttacgggcagtatttaccaatactcctcctttaggcatcttgttaaccaattcatagttgatggaatttttagtttcagccgtagcaggaatatgcagggacactacattacaagcagcatacagttcctcagcagaagaaacagctttcacaccatctttttcaattacttctttcgggcagaaagcgtcaaaagcataaatatccatgccaaaacctttagcaatacgagccacattgcgacctacattaccgtatgcatggatacctaacttcttgcccatcagttcagtacccgaagtcccgttatagaaattgcggacagccatcaccatcatgccaaaagccagttcggctactgcattggaattctgtcccggagtattcataacacatacattgtgtgccgtagcagccgccaaatccacgttatcataacctgctcctgcacgtactacgattttcagttcttttgccgcatccaatacttcggcatcaataatatcacttcggataatgatggcgttaacgtcctttacagcttccagtaatttggctttttcaccatatttttccagcaatacaagttcataacctgcagcttctatttctttacggataccgtctactgcaacttttgcaaacggcttgtctgttgctactaatactttcatggtcttattgtattaaaaagattcaccacagattagcacggattatcacagattccatttattgttcctatctgtgtaattcgtataatctgtggtgaacataattattaatgaagtttctcaaattcctgcatgcagtcaatcaaagcctgaacgctttccttcggcatggcgttgtagcaagatgcacggaaaccacctacagaacggtgtcccttaatacccaccatacctctttctgtggcaaatttcatgaaatcggcttccagctctttgtattcgtcattcatcacaaagcaaatgttcatataagaacggtcggctttatccgttactgtgccacggaacattttgttacggtctatttcagcatacaacatgtctgctttctctttagcacgtttctgcatttctgctacaccaccgttagcttttatccagcgtaaagtctgcaaagcggcataaataggaagtacaggaggtgtgttgaacatagagccgccgtcaatgtgagtctgataattcagcatagtagggatatagcgtgataccttgcccacagcatcgttctttacaataacgaaagtaacaccggctggagccaaattcttctgcgcaccgccatagatacaaatatatttagaaacgtcaataggacgagagaaaatatcagatgacatatcagcaatcataggaaccggagaatccaggtcttcatgaagttctgttccatagattgtgttattagttgtgacgtggaaataatctgcatcagcgggaaccgtataatctttgggaatataggtataggtcgcttcagcggaagatgctacttctactacctcaccgaaagccttggcttctttcatcgctttcttagcccatacgcctgtattcaggtaagcagcttttttttcgaggaagttgaaaggtatcatacagaattccaagctggctccacctcccaagaatagtaccgagtacccttccgggatgttcaacagttccttaaacaaagcaacagcttcgtctactacaggctgaaaatctttagcacggtgactgatttccatgatggaaagaccagaaccattaaaatcaagaacggcttgtgctgttttctcaattacctcgcgaggcaagatagatggtcccgcattgaaattatgctttttcatttgaagtttgttttggttatacaatttgtttatatcttacattgggcgaaattacacattattttcagttttccaaaaaaatcgctaataaatttacgaatttccgcataattttctttcaaattagttaaatctgaatttttatgctttcattttgtaactacatccctagtaaacaatgatctaaagcataaaaaaaatatctttttgaattattctttaatcatttcatttcgagaattgacaaattgtcattatttggcttcttcaataagtgtttttatgccctttatcttctcgtttcgtattaaattcaaagtttgttttatctttttgcgagatacggctgcaaaagaatagtggtcctttacatcaatccgtcctatttcgtctttattcaagttaccttttttaaagagaaagcccacaatatctatcttattgattttatcttttttgcctttccctatatataatgttacgtattcgggcaaggacggcttgggaggcacttggggcaatatgaattcttccggctcatcggctatatatccgggcagtgtttcttcagcatgaagaataacgtatgaatttccttcggcttcccaacgggcggtacgtccgttacgatggatataaccgtcctcattggcaggtagatgataatgtaccacgttctctatttcggggatatccagtccgcgagcggccagatcggtagaaataagcacatggcaacttccgttgcggaatttatatagggagcgttcacggtcatcctgttccatgccgccatgaaaaatgccacattgaaacttcttggattgaagatactttcctaccctttccacactttcacggtgattacagaaaaccaatgtcgattggcttcccaaggtacaaagtagtttatacaaggtttcaagtttgtctttttccggagatagtaccttatataaatgcagtcgctgggtaagctgctcttccggatttaaaaaattcaatttaatggtcttgttcagccccgtaaactgcggaatctcttccgcatcggtggccgacaacagaaaacggcgttgcagaccgggtaactgtcctatgacagtcgccatctcttcctgaaaaccgaattccagacatttatcaaattcatctattatcaaaatggaaaccgtgtctgcatcaaaattctgtttggaaagatggtcattcatacggcccggtgtaccgatgataactgatggctgcacccctttgatggtacggtgctcttccatggcaggtcgtccgccatagcaactcacagccttgaatggcgtattcatggatttgaatacctgatctatttgtaaagccagctcccgggaaggaaccagcactatagcctgtacgcctgttataccaggcttcaaactctgcaccaaaggcaacagataagctaacgtcttgccggatcccgtaggagacaataatattaagtcttttccctttttccaagcatcaatggatgcctcttgcatcgggttcagtcgctcaattttcaaattggctagtatgttctctatcatatttattttcgttttatacaaaagtaaagaaaaagcccgataaaagttcacttttaccgggcttattttcattattaataaaaggagatcctgatattatcctccgaagttatcgtacatgatagaagaaggttcaacacccagactatccagcatcttaacgactgcattagacatcggaccgggaccacacatgtagtattcaatatcttcgggagcttcgtgatccttcaaataagtttcatacatcacattgtgaacgaaacctgcggtatacttcacgcctgctgcatcggctgcgggatccggacggtccaaagccagatggaagtggaagttcgggaagtctttttccaattgctggaaatcttgcagatagaatacttcattcaatgcacgcgcaccatagaaatagtgaagttcacggtcggtagtgtgcagtgtcttggtcatgtgcataatctgcgcacgcaatggagccataccggcaccaccacctacccaaatcatttccttcttagaatcgaagatcgggtggaagtctccgtaaggaccactcatcgttaccttgtcacccggtttcagcgtgaaaatgtaagatgaagcgatacccggattcacatccataaagccgggaccctgatctttcggtttgaacggaggagtagcgatacgtactgtcagcatgatacggtcgccctcggcaggatagttggccatagagtaagcacggattgtttcttccgtattcttgcatttcaagccgaacaggccgaatttttcccatgcgggcagatactccggaccgataaggtctttgtcaatatccttgttgtagtccatttcaaatttaggaatcttaatctgggcgtatgaacccggaacaaagtccatgtgttcacctttcggcaaagccacaataaactctttgatgaaagtggcaacgttcttgttgctgattacttcgcattcccattccttaacacccattacagattcatcaatcttgatgcccaggtctccttttactttcacctggcaacccagacgccaatgatcctgttgttgtttacggctgaaatgtcctttttcagaaggaagaatctcaccaccgccttctacaacctggcatttacattgaccgcaagaacctttaccaccacaagccgatgacaggtatataccattaacagacagggtgttcagcaaagttgaaccttgttctacttccagttctttctctccattgatagttatctttactttgccgctcggagtaagatactgcttagctaccagcaaaataacaacgagcagaaggataattccaaggaatactccaatactagctaatattaaattcatatccattgtcttattcctttccttttagattttcaaacctgagaaacacataaatgccattgccatcaaacctacagtgatgaaagtgatacccagacctttcaaaggagcaggaacatcagagtaagccattttttcacggatagcagccagaccgataatagccagtgcccaaccgatacctgagcccaaagcgtaagttgttgcctcgccaatgttgatgaaatgacgttgctgcataaacagtgaagcacccatgatagcacagtttacagcaatcagcggaaggaagatacccaatgaagcatagagtgacgggctgaaacgttcaaccgccatttccaccaactgaacgataccggcgataacggcaataaacaggataaagctcaagaaactgaggtctactccttctaccagcgcattaggtgccagtacgtaattttccagcatatagttcaccggcaaagttacaatcaacacgaaagtaacggctgcacccagacctacggctgtctttacgttcttcgatactgccaggtaagaacacatccccaggaagtatgcgaaaatcatattgtccacaaagatggactttacaaacaaacttaaatattccatattcttttcgttttatagcggggattaattattactttcctgcaattctttgtgttttgcacgttggtaccagatgatacaagcgcagataatcaacgccataggaggcatcaacatcaagccgttgttcaagtagcccaagtcataaacagcctgcgggataacttggaagccgaacagtgtacctgcacccagcagttcacggaagaatgccacgataatcaggattttggcataacccaatccgttaccgataccatccaggaatgattcccaaggaccgttcatcatagcaaacgcttccagacgtcccatcaggatacagtttgtaataatcaaacctacatatacagaaagctgtacgcttacatcgtatgcgaatgctttcaaaatttcactaacgatagtcaccaatgcagcaacaaccaccaactgaacgatgatacggatacggttgggaatggtgttacgcaacaaggagataacgaagtttgagaaggctgtaataatggttacagaaagccccattacgatagccggttccaactgagccgttacagccagtgcagaacagataccgagcacctgtacggtgacagggttattcaaacccagcggggttaaaagaacttctctattctttttagaaaataatgcgctcatattctatttaccctcctcttatttattagttaaaaatgaattgtacatgctcaggcaatccttaatcatcgcatctacacccttagaagtgatagtacctcctgagataccgtctacctgatagtcaggttttgccaccttgccatgtttctcaacgcctaaagctacaataccgttttccaacacatgtttgccaaggaattggtcttgaaacttaactgtcgtgatttccgcacccagacccggagtctcaccggcgtgtgagaaataaacgccatatacggtgtctttatcttggtctaatgcaatgtatccccatacaggaccccaaagtccggcaccataaacaggaaggatgtatttggtctgaccatctacattacattcgaaaacgtgcagacggttgtttgctatttcacccttataagaagtctggaacgctccgtcgttaggagccaatgttccgtccggctgaaccagcatgtccttaatctcatattttgtaaattctgcatcgacatcctttacatcataaacgttcagagcagccagaatttgtttcttggtgtccatttccacgttcttatactgtgtttctttcaaagaagaagaaacgaatgccagcaggaatgctacgacaacaaccattatcgaagcatagatgatagtataactattactattggtattcataatgtccgatattttagttgttagttgattttaatctgttttcgcgggctgtgatgttcttctgtacgatacagtagtcaatcagcggagcgaagatgttcatcagcaggatggcaagcatcataccttcaggataacccggattcaacacacggattacaatggccatcacaccgatcaggaaaccgtagatgaacttacctttttccgtacgtgcggaagttacagggtcggtagccatgaacacagcaccgaagcagaaaccgcccaatacgatgtgttcgtaccaaggcaactgagccatcatgttatcagtagaaccgaatacattgaaaatcaatcccatcacgataccaccggcaaagactgagaacatcgtcttccaacttgccacacctgtccacagcaggatgatagcgcccagtgcgatagcgataacgctggtttcaccgatagaacccggaatcaaacctacaaccatatcccacatggtagcgggagtaccgttcacattaatcagttcgcttgcacccggagcggctgtagcagcctgtcccaacatcgtagcaccggtaaaaccgtccactacctgtccgccgccaatgccgaaaatgctgtcagtgcttacccaaacggcatcaccggacatcttggtaggataggcgaagaacaagaaagcacgggtaatcaaagcagggttgaagatattcatacctgtaccaccgaatacttccttagcgaagataacggagaacgcagtagcaacagccagaatccacaacggacattccacaggaacgatcatcgggatcaacagaccggataccaggaagccttcttgaatttcttcattcttccattgtgccaccacaaattcgattcccagacctactacgtatgatacaataatcttaggcagaactgccaggaaaccataaataaacttttcaaagaaacctgcctcctggcctactgccagaaagtgctggtaacctacgttgtacataccgaacaacagggccggtatcaacgcaataaccaccattgacatgatacgcttgctgtcaatcgcatcatgaatgtgaactcctgttttcgaagtgctgttgggtacgaacaagaatgtttcgaaaccgtcgaacaccgaacgaaacgcgtggagtttgccgccctcttcaaagtttggctttatcttgtcgagataatttcttaacgctttcattaacttttaattcttagtttttaattatttagcacatttccttgcgaagcatgtccagaccttgacgtacgatgcgttgcaattccaatttggaagagtcaacaaattcgcatacagcgaagtcttcgggagccacttcgtaaataccaagtgcttccatgcggtcaatatcgccggcaatgatagctttaattaaatattcggggaaaatgctcatcgggaataccttgtcatattcaccggacatgatcatgtgacgttcgccacctttgatacgggcgtccagtgtatattccttgttaccgcacaaccaactgaaataactgcggttggcactgtactgatcggtacgcggcatgataaagcccaagaattcgtgctggtcatctccttcgggaatcacagtgaggcttgtagcgtgtgcgcccaggaatccgttaggtttcaccaaagttccggtcagcacgttaccgttaatgtagcgtaagtttttacctccgttcacacgtcctgcaaaaatatctgtcagcagggctcctactttcagcttgcaataagccggtttctttacttccgaaccggtcagggcgatagtacgggtaaggtctacgcgacccgtattgaacagacgtccgatgaagatcacttcttccgcacggagcgtccaaacagtttcgcctttgttaataggactgatgtggttaatctgaacgcctacgtttccggcggggttaggaccgtcgaaggcagttacagttacatttttggcgttggtcagtgcaggactcttctgctctacgctgatattcagatacgtctttgccatctttgccagtgcgtccagacctgtctggaaatctttttcctggcctttcagaacaaattcgaaatcagcagccaatgggttagtgtcaaatgcagaaacgaagatgccttttggttgggcattcggatcagccaccacgatgtatgggcgctgaatgatgaatgaaaagagtccggcttccagcagagcagcttttacctgttctcctgtcagagttgaaacatctttctttccaaactcttcatagtcctgctcctttgctgctgcaatggagatgcttaggactttacgacgctcgcctctctccacgctggtaacgacaccgcttaccggagatacgaacttcacttcggggtggttcttgtcaacaaacaatgttcccccggccatcacatattcctgttccttgaccacgactttcggagtcacgccatgaaaatcatcgggcactatcgcatagatgtccggctgcttcacgtcaaagaactcctgaacgggttttcctttcaggttgatgttcaagcctttgtgtaatttaatcacatttgccatattgggttataaaaaatggtttttaaatttgagcgcaaaagtacagaaaaaaaatgtgaaaaaagaaagaattggcgcttattatggaaaaaattctgtaataatagaaacctttctgaatgtatgtgcaaactcaggcagatactcacttttttttagaacacaaatgacgggaatggcataaatttatcttgatttttaatttatgtcattctcgtcatttgtgtttcattccggaaacacttacagtttgacggtcttcactttgccgggaatgatggtcaggtgtaccgtgccattgttttctatatctaccttctggtagcaggcttccaccatcactttcccgtccagtgccatcaccccccaccggcaggcgctctcttcaaaagcacaataaacgcccacaggaggaagaatctttctgtatttgggaggaacgatgatacgttcccccagtttcaagccccatttcatgcccatacggtacggaagggcatctcttatctcctccagcctcttccgccttttcgcttcctcgttccttctcttctgccggtccgtttcctccgcccgctgtccggcttcctctttcagcttctttacagccgtgtcgaagtcctgctcaccgggtctgggaaggttagtggcaatgtaccgcttcctctttcctttttccacatggtaataccttccagccccgtccatcaccacgatgctccggtcggccagacggccgcagcaccaataaacttcctcgtcatcccctgccaacaagcaggcgaacacatcaaacaccgtggaccacacggaatccaccagcttgcaggacttcggtacgcgataatccggtatcttcaagtaatattcataaaagcagatgctgtctttatgcaacccgttcatggaggcgtatgctttttttgtacggctatggaaagtctcccctaccctcagcaatttcacaccgccgtaggaaaacaccaccggcttctcccggtaagtgcggcctgttttcatgtccatgtaggaaaccgtgccgacagtatccgtaacagccagcagttcctctttcaggaacttcaatctccgacaatacccgagtatcacttccggctccccggaggcactcaccactcctgcctgtccatctttcaaacggactgccacacggtttccctgaatgttaaagacttgcagataacggggagacactgttatcttgtttccacgcttcagcccccacaagctactccgccggtcgggataagatttcaaggcggcttgtgattcctttccctcttctgcttcctcccggttccggatggcttccagcaaccggtcgtgagtcataacaatctcccatacctcctcctcctgcccgccactgtccgtcaatgacaaagcaggcaggtacaatccgccttccgtccgtgcccgggacagcgcgttgccaatcatccgtccctcgaacatcgccgcccatttaagttttatctactcatttctgttatcgcttgctttcctgttacttatgcatgcagctcagcacctttctgccatttagaatcccatatagcattttctgcactatttacttttctatactcttcctctatcaacagagagaaagtcaaaggaccgtaattcacgctggcactgttttgattggtctgccatctttgaacagataaagacatgggtaattgcaagattaccacatctccattactccaagttctatccaaacgaacatatttaccagactccataccagcagctaccgtttctccgttaactattaatgtagcccccttgcaccaagcaggtacacgaagatataatggaaaatccactttaccggaaacttgcactgtaaaccgaatcatttcttcaaacggatagtttgtttcttctctcagaataacttcagtaccgtttacccctactttcgcctgtgcacaacacggaccgtaaataatggcggcaagcccgttatccggagttgcataaaccaaattttcaatatagtaaggccagccttgcgcatggttatgctgacagcaacgactgctgaaaggattcatagccaaaaaaggacctccattatcaattccgggtttatgatctttagaatcactcaccacctgattgggacaagtgatatatcttaaagctttgaaatcaggcattaccgccgccggataagaattgaaagcgacctcctcgcaatgctcagcccaaaaaggatcaccggtcatacgaagcattatctcatcagacgccatctgttctacaaatccacaagtttctgtaccttgtcgtggatcaatataagccaaacgggcattctcgtccgctccgaacatacctcccggcacctgtccgaaaatacgtctcaccagatgatgcactcgataagatgcctgcaaatctgccgaatcaccactaagcatatagtaagtagccggttcacgaaagcactgtgcaatattcacattatgccaattaggcaaatccgattcatttgtccagtctgccgtattacgatgaagtttccgagcaagctccagcaggaattgttctcctgtgatgttataaagccaataaacactatacagattatcccccccacggctgttctcccaataatcttccaaaaatttatcatcggggacagttagttgccatttaaagtaatcagtcatcaaagtcaacactctcttatcaccagaatattcataataagattgcaaacaccaaagcattaccatattcgcccaaagttctctcttccctccacgttcattcaccggaccgaaaaagccatccggttgccggctctgaatagctgcttcaatccagacttttgtttctgcaatcatagcagaatcttttaagatataagccaaatcaccatatcctttcagccaataagggacttcttcccaaccatgatctccaccagacagcaaccacgcattatccttcttatccaaccacgcactaatttcacccagtttcccggttaatccctctttttgcaacagcaggtactttttcagccagccttccggctcaatggttcctaccggcaattttataaaatgcaatggtttcaaaggcaaacgatttccctgataactgacattcctatctatcgtaccgggacgtgaaagcatatctatcttcatctcccttttttcctccatacatgctgtcagtacagccacaatcaaaaaggaacctaataacaatttccctatatttctctttttcttaaacataccgttttttattcaaattttacatcagcaaaagtacatctgtccctgagtttcatggaaaagaatcttgtcagaaaaagaaagaatataaccattttactcattcagaagtttttcagcccatatcatcgtattttctttacttttaatccgctaataacaccttgtcctttttgaggagaaagcagaatctccagtccttcatgattccgcacattgaccacaagtgtctttacaacagctgtctgctcgccataagaatcagccagattcaatgactctatcaatttttctccattgactgacacatcaaatacacgttgtccctcggcagaaacacctgtatgcacaatatttttccgttcatccttactgaaaggttccgtgaaataaaagccaatttcatatactccgtcaggaacatccagccggtaacaagtcgtaccaatcaaaaaggtctgaaaaagaggctctaaaaaagtattttttatatcagcccctactccatacctaactccatcatgtgatgatcccggccaagagttaaaaggttttccatccatatatccccaacttccctttgtataaggtttatcgggtatccatatttcctgaagctgcgggtctataaaataacaatgctcctgtcccaaattaatacaaagaccgtccaaaagcacatcactgtcagtaagacgggaagataacaatttcatctgtatcttcagcctgtctgaaagtgccccacttcgagcatccagcagattctctccgtttataaaaggaactgcgaaaacagcttccccatttaccacttcacgcacacccaaagactttccattatgaattaactccaccgttttctgattagaaaaaacactgatcttacgcacatttatactatcatcacaaatttccacccttttcgtccaatcggccccggcaatatgaatcatcggaatgtccgaccaacgagcctgacagtaataataaatctctttcttccgacgatcctctgtcaacattcctttttgattcagattaggcttgctatcaccacgaccatccacctgaaaatcaaccaaattccaaatagaataacctatataatccggacgtttctccatttcattgatatatctgcgattaaaatccaattgaaattccggagtaaaatcaaatgtacgcggagtataagaatggatacgttcatcgcttcctgctccaaattccgacaaaaaacgaggttttgcagtagaataactacaaaatttatcaaacataggtgcaatcgtagcagaatctccctgataccaagactcatatacattcaccccgttaacatccgaaatactaaacatctccttactagactgtgtatagggtttctcccaagtaaaagcatgaaaggcgacacaagaaagacgataaggatccagctcttttttcaaagcctccaactccctagccaacgcaatagcttgcttatggtaatcccataattcattcatagccccccatagtaccaccgatggatgattgtagttctgaagaatcatctctttcaacatttctttgcagttatgagcgaatgccgcattttttctcacttcattcacaacacaaatttcagaccatactatcaaccccaattcgtcacaggctcgatatatttccggatcttgaggataatgactgatacgcacaaaattagctcccatttctttcagcaaccgcatatccctacgattcatttcaacgggaatagccgttcccaaacctgcataatcctgatgccgtgcagctcccctcaatttaagatacttcccgttcagataaaagcctgtcttgtccaccgaaaaccatctgaatccaaccggagaaattacttcttgatacatttctccattcttggcatcgcatacctgcacttttaccgtatataaataaggcaattcaggagaccacaaatgaggattctctatccttcctacagaagtggatataggatatttcctgcctggaatcagtttcagtttcaactgtttctctttcacaatccgattcatttcatcgcaaagaaaaacattgacgtgcacgtgctttgtatcggtaaagtcatttttaagaaaagccacaatttgcattgacgcctcagataccgacacttcaggggtttgtatccttactggaacagctgcataaggttctgtcacaaaatgcactttttccgtccattgcaagaacaccctgcgataaatacccccaaaaatagaaaaatctccggaaaccggtggaaggatttcccccaaagaagaactattatccacttttaccgccaacagattttcctttccaacttcacagatatcagttatatcaactccgaaagcggtatatgcccccaaatgagttttcaataatttcccatttaaatagacgtctgccttgctggccactccatcaaaacgaagagttattttcttatcccgtgcctctgaaggaatgaacaacttcttcctataccaagatatgccacgcctatatccccgttgctcgtcaatcacatctccggcattccaagtatgaggcaaatctacagttacccaatcagaatcattccaatccatactggaaaaacgttcatcattctctgctttatacttccatgaatctgttatagaaatttcagaggcacatatacaacatatacatccccagaaaaacaacaaccaaccggcaaaccttttcataccatcacttcaaataaatattaaaagaaaaagactgtccggaaccgcacatgacaaaaagtgccaaacaggttttcggacagtctgttcattaccaatccactaatatcccggattctgctttaacttaccattcttatccaattcagctcttggaataggatacaagttcttatttatatcatttgtagcagaatgagaaagccatgatttagttgtccatactccaaaacgaatcaagtcctgccttcttcttccttcttggttaaactcccaacccaattcatccaaaaagcgaccatattttatatctgctccaccttcatgagttgttctaggacttttaatcttgtccaaataggttgtttcgcgcaatccataatcataggtactccctcccatcagttccgcaccagtgactaccgctttttccggagcagacttgaatgcgcgttgtctgatttctgttacaatttgtgccgcttcgtccgcttttccagtccttaacaaacattcagctttcatcatcaatatatctgtatagcggaaggggaaaacatcgttactcatagcaccaggagacataccggcaacatactcatactttgccaaatgatatccatgtaattcctcagcccaatcaacccccggaaccacatttacaatattcataggaatcccctgactgttgcctatctcgcacaacacattggaaccatcgggatacacttgctgtcccatcaaataattctcggtcagacgactgtcatccggatcaaatgtatttataaattgcggaacagcaaccgaacctccccaaccaccaaaactcttagtggaatatacctgagagaactgaccgtttaaagcgtaattgaatatattcaatccaccggcgtaactttgatcaaaaggaacagcaaaaacagcttccgtacaatcctcattatcagccttgaatacatctttctgatttcccgccaacgagaatttaccagattttatgatctcctcacaggcatccagacacttttgccattgtggggttcccgtatacatctccgcattgatatacatcttggccaataaagcataagcagcccatttggtaaaacgtccgtaagtcgattcatcaacattctccggtaataaaggaagggcggctgtcacttcggcaatgatagaatcattcaaggctttacgactgatttgttcgggaagaaaaccttgagggacatcaaaacgggtcagatagggtacattgccgtaataatcacaaagcatataataataagaagcccttaccgcttttaactccgccaaataattatccttaccttccgtcacaggcaacaggccggattcaatctggtaaattacctgattggcattgtttataccagtatacaggtcaccccaccgattaacagcctcacctgtctccgaagtccagatatgtaaatgcatgttaatggtagtcccattccatccccaaggatgtaccggtatcatggtctcatctgtagaaatggtctgcgtttcatttattgcaccgataacaacagaacgccatggagtataagcattacctaatatggcaaccatgtccttttccgtataatgatatttatcggatacgatcgtagtatacacgctatcgtccagttccatacaactattcaatgatgctcctatcagacaacaaagtgcaggacacatcaatgctattcttattcttcttttcatgttcttcaatctaataatttaaaaattcaagttaacgccaaaggtatatgaacgggtagtgggatacttgtttctgtcatctgttcccggagttaaaagcgaaccgcctacctccggatcaagtcctttgtatccggtaatggtcaaagcgttttgaacagagaaatacagacgcattcccttaatccctttaataaagtctttcttgaaattataccccaatacaatattatcaattttccaataatcgccatcctccacatagtaactattaaattgcttggagtccgtcagcaccgctttaccaaatactttttcatacccggctttcaaattattcattgcctggtctctataattctcataatgcagacgagtaaagttgatattctggaatccaaaggctcctctcatggtaacgctcaaatcaaaatttttataacggaaatcattgttccatcccaaataatgctttggcaaaccattaccaatcacttttctatcctctatcttcacatctttagactctacagcattaccattctgatcttcataaatccatttaccgtcttctgtaatatccaatactttccaaccccaaatctgccctataggctcccctacttttacacgatgggtagggactcccgacataggcgcttgtgcgtcacccacataaaaataatcgtttgccaactggtatttactattattcaatttgtcaagcttattcttattagtagaataagtcagtgtggtattccaaccaaaatcttttttattaaagacaaccccgttcagcaatatctccagtcccttattactgatagtacccacatttgccagtgtagtgccatatacattgggtggaacaggaacaggataattatataacaagtctacagtttttctgtaataagcatcaacactaccactgatacgatctttcagaatagagaaatcaagccccacattaaattccttcttcttttcccatgtgaattccggattcggattactctgcggagtcaatttattcacccattgaccattataataaaaagtatcattatttgaagtatatcccaaacgataggttgccaaataaggattggaaggagcaatacctgtcacaccataaccggcacgaagtttcaagctattaatccacttgatatttttcataaaattctcttcattaatccgccatgccagacttacagccggaaatgtaccccaaacctgatcggaacccacaaatttggagtctgcctcatgccttacactaatggtagccaaatacttgcccgccaatatgtaattgatacgtccgaaaaaactgataagattacctgacgttttattactgttaataggaatagcagcaccggcaatatcgctgtcgccacgtcctaaagcgatattatcccagccaaactggtctgtaggaaaattccagttccgcatccaataatcctcccatatattcttctgatagccataacctcccaatacagaaatattatgaatgccaaaaacttcactatactgagcggtaaattcaaacaactggtctgtagtctcacaagtacctctggaggcaaaaccgtcacgggaatgagccactgtggtattgaaattatcaaaagtctcacgataaccccttgtttcgtaatatctatcccaagataacaaagcattgaatttcaatgattcgatgggttggaaagtaacattaccattcaatctggtacgctgtctgtgatgtctgccattagctgtctcgatagtactcagcggattggcgatagccaccagagccgaaggctgtgcccaaggaccatcatactccggcattgatgacaggacatccttatttacatcctgcttataaataggcaaggtaggattagtaaccaatgccgcactatatacccctctattgaaagaggaaccatctccggtcgttgtatagttctgcgtattagaattaacgctgacgttcaaacgcaatttatcattcaacattgaatgattcaccgccagtcgtacaatcaacgcctcattatctgactttttgaaaattccctggttctttttataattgacattcaacaaataattagtcttctcggaaccaccctttacactcagattatgcccatgattgaccggagtacgagttatggcttccagccaatctgtattacctccaaaatcagtagcagaaattgttccatcctgaattaaagaacgaaattcatctccagtcaacactctttccgttttcacaaactcttctgtaccgacatacccattatagtctatggaaaaatcagaattagccttacgggtagtaaccaaaatcaccccattggtagctcgtgtaccataaatagccgcagacgaaccatccttcaacacatcgatttgagcaatatcctcaggagccaccgttcttaaatctcccggaataccgtcaatcaacactaatggcgaattgttaccctgcaaggagttagtaccacgaagtaagatagacgaattctcggtagggtcacctgtagaattcacaatgctaagaccagcaattttccctttcaataattgccccgcatccctcacatttccacggacaaaatccgaagacttgacacttgagatggcagccgtcagctcacttttcttttgcgaaccgtaacccaccactacaacttcctccagcgccagagaagaaggtttcaactgtaccttgacaaaggtctggctacccacatttatctcttgggcatcataacctatataagaaacaatcaaaacagtattcttatcacttgcctccacactaaaattaccatctatatcggtaatggttccctgagaagtacctttaagaataaccgacgcaccgatcagtgcatccttatgttcatcatataccgttccctttattattctgctctgagcaaacaagcattgggaaacgagtaaaaacaagcccaacatcaacatcgttgtttgtcgatgtccaaattcagacggatgtgcacctttactaaacatgtttttcatattcgatatttaatttaattacagcccaaaagtagacctattagagaaaaagccacaagaatatccatccaaataatatgaattttctgccaaaacaatattttcacccaccttttacaccaccttacctcctccaccttacgaaaagagagcaatattctgccaaaacaggacaatattttgccttccccttgtgtttttcagccaaatatctacttttgcatcatagtaaaccacttgataaaacaaactatgtacaagcacttattccttctcatatcaatccttttcagcctctcatcccccagtgttcatgctgaaagatattatttccaacatttgggtctgaaaaacaaactgtctcaaagttccgttctttgtatcacccaagacagaaacggattcatgtggttcggcaccaaagacggactaaaccgttatgacggatccaatttccgtattttcaaacacaatcattccaatcctcattctttgggtaataacaacgtcaactcattgcacgaaaataaggatgggaaattatggataggaacagacgacggaatttatatctatgatccattgacggaaactttctcaaaactcacctgcaaaagtcaggacagcttgtgcatcacccagcccattgtacaaatcaccaccgatacacaaaaaaacatctggatagcagtagaatcccaaggcgttttcctgttcgataacgaccgacaaacattaacacactatgctatccccgatgcccatctactcagttctatctgtatagaccagcaaaacgcagtatggataggctataacggaaaagggctttattatactgatgatcatttccagaacttccggttattccaaacacaagaggggaaaaacctcttcaccgatgaccagattttcaaaattttccccgaacagcataacaccttgtacactggttccgcaaaaggtggtctgaaaagtatcaatatccttacccggacagtcaccgacttgctaccggactcttcccaaaccgaaagtatctttgtaagaaacatctatcccatcgacaaaaaaacattgtgggttgccacagaacgaggaatatacacttacaacaaggaaacccgggaaatccaacacctcacctacaatcccaacgatgactattccttgtcggacaatgccatttattccctctacaaggatgctgaaggtggcatatggatcggcagctatttcggaggcatagactattatcccacccaatatgccaccttcgaaaaatactatcccatcataggacaaaacagcctcagcggaaaagtagtccgtgaattttgcgaagatgaagacggaaatctatggataggaacagaagacggcggcttgaacaaattcaatccaaagaccaaagaattcagcccttgtccactggcaggactgcactataatgtccacgctctaagtatggacaatcacactctgtggataggtacatattccaaaggattatattcattggatctgaagacccaccgttcccgtcactacctgatgggacatgccgaaaatacattgaacgacaacaacatctattccatgtgccgcacctctgcaggtcaactctacataggtaccacaaccggactcaatctctataaccatgaaacaaatgatttcacccgtatccacaaaatggatggtatctttgttttcaacatattggaagacagtaaaggaaatatctggtttgccacctataactccggtatattcaaatacaatcctagaaataacagctggaaaaattatgtttctactcccggagttccccacggactcccttacaacaaggtgataagtatttatgaagacagcaagcaacgtttgtggttcaccatgctgggaagaggattctgctcattcaaccaggacacagaggaattcactacttatgattcttcacaagggcttgccaatgatgtgatttataagattgtagaagccaacaatgacatcctttggctcacctccaacaaaggattgatacggttcgatctgaagaccaaaacctcgaacatttatgcagacaacaatggactgctcaccaatcagttcaattatagttcaggaattaagagcaaagacggtaccatctatttcggatgtatcaatggcttcattgccttcaaacccgagtccttcaccgaaaacacttattttccacctgtagccatcaccgatttcctgcttttcaacaaaagcgccgatataggcaccaaagattcccccctcagtcaaagcgtgacttatacccgggaaataaacctgaagtataatcgaaactcttttgccttccgctttgcagctctttgttacgccgcccctgaagaaaattatctgagttatacattgaaaggatttgataaagagtggtacagtaccacaaaaagttccaccgcttcctataccaatctaaagccaggcgactatactttctgcgtgaaaacagcttacgccaagggagaatggagtaatgacatcaaaagtatccacatacatatcgcacctcctttctggaaatccccgtgggcctatcttctttattttatactttcggcagccggtatcggatatatcttctatcgcttccgaaaacaaatcacggacaaacaacgacgacaactggaaatcttagaagccgaaaaggaaaaagaaatttatcatgccaaaatagacttcttcactaatatagcacatgaaatccgcacaccgctaaccctgataaaaggcccgttagagaacatcctgcacaaggaaaacatagatcgcaacaccatccgtgagaacctggacgtcatggaacggaataccctgcgattacttgacctgaccaatcagttactcgacttccgaaaaacagaaaccaaggggttccgtcttaactttatggattgtaatatctcccaactaataagagacacttatatccgtttcaatcccgccgcccaacagaatgggttgaaatttcaaacagacctgcccgaacaggatttcaatgcacccgtagataaagaagccctgaccaaaattctaagcaatctgttcaataatgcagtaaaatatgccacatcatctatccatgtatctttaataccaccatgcggaatgaaagaaccgggatacttctccattatggtcagcaatgacgggcatcccatcccacacgatatgcaagaaaaaattttccagccttttgtgcaaatcaaacaaacctccggtgggcaacgcacagccggtaccggcatcggcctgcctttggcacgttccctggcagaattacataaaggaaaactttatttaaaggatagggaagaaatctgtttctgtgtcgagcttcctgtcgatcaagaaaaagccatacagttgcaaaaagattccactatcagccagaccggcaatatgcaaacagtcatccggcaacacagcactaacatctgtattcttgtagtagaggatgaccccgagatgcagaactttatttgcgcacaactggaaactgtatattgcgttatacgtgcatctaatggcaaggaagccctgcaagtgctatcagaaaagacaatcagtctgattgtcagtgatgtgatgatgcccgaaatggatggtttcgaattatgccatacattaaagaccgatatagaacatagccatattcctatcattctgctcacagcaaaagttaccatgcaatccaagatagaaggaatagaactaggagccgacgactatatagaaaaacctttttctacggagtatttattggcacgcatagcgaacttattaagcaatcaggacaaattgcgccatgctttcacttcatcaccttttgtgaacgccaaaaccattgcactgagcaaagcagatgagaactttttagacaaactaatagaagtaattcagaagaacatttcggaacccgattttaatgtggatatattagccgagaaaatgaatatgagccgttccagcctgcatcgaaaaataaagggaatcgctcaaattacccccaatgagtttattcaactggaacggttgaaaatggcagcccaactgattcaatccggagaatacagaatcaatgaagtatgctatattgtcggtttcaactcttcttcctattttgccaaatgttttcagaaacaatttggagtactgccaaaagatttttgcaagaacggctcctgacactgtaagataatttatatatgcgtataaaatagtccttttaaatttggcataatgccatgaatccattacatttgttccatatcacaaatgatagaattatgcaagatataacaaacggacgttgcggttggtgcggaacagacgaattgtatatgaaataccatgatcaggagtggggaaagttagtaaccgatgacaagacgctgtttgagtttcttgtattggaaagtgcccaagcaggactaagctggataacgattcttagaaaaagagaggggtatcgtaaagccttctgtaattttgatgccgagttggtggcacaaatgaccgatgaagacgttgagcggctaatgcaatttgagggcattgtaaaaaaccgtctgaaaatcaaatcgacaatcacgaatgcaagactattccttgccgtacaaaaggaattcggcagtttttataattataccctgtcattctttcccgacaaaaagccgattatcaacacattccggtcattgagcgagattccggtatcctcccccgaatccgatgccatgagtaaagatatgaaaaaacgaggtttcaagttcttcggaactacgatttgctacgcccatttgcaagcttcaggttttatcaacgatcatttgacagactgtatttgccggaaagttccacaacagaattattaactctgttaacactatcatcaccttttatcggaaacctcaatatgtcttttcctccttttcttttcgagaaaaatagcaacgatatgacagccgggattgaattcaagactataagggtatctgtaattcaatagtttcatgcatatatcttgactgagccgaaaagaaagagatgttctgttcccagattgcataacaagacatttttgggctttgtgagagcagttgctctcaccttttggggcatctctcacctcatctctcaccctttaaacgctttattcatcgggggaaagtgataaaagatgagagcatgagagataaaatgtgttttttgcattgataggagtagtcccgaaagttaacggcataactttcggaaacaatggaagaaacttcctaaacttatgctgtcagtttgtaaaaacctcccgtcgtgaaagggaaaatgttccgaggaaagacaacctgttttatacgaatgttcatgcggcacttcatgaacgttcacgtaggactatatatacgtccgcgtgaggttacacatatatatgtgggaatcatcaattttttgttcatgtacaaaaacacaagttcctatgcaaaaaagataaggatgttttttaaaaacataagttcattttaaaaaaagaacaagacctttttaaaaaacgaacttatgttatttaccaacttttgcaagctaaataacttctctgccaatcatcaagatacaccttcaccggaaatcaaacttcagcctgacaggcacacttaattgtaaccggcattttgcccgaactcttctttattgataatggcatccagttgagtctgaggaataggacgtagcaaatgatgctcttttatattcactttcgcatccggattgtatgcttttactctttccagcagcttaccggtacgcttcaaatcgaaccaacgttgctgctctcctcccaactcacgggcccgttcatccaaaataaaatccaatgtcaactgttccggctttatcttcatggcggcttccttgccgggaatagctgctcttctccttacctcattgatataagatgttccagaggcattatcgttcaagaataattcagcctcggcagctatcagatacaactcagcaagacgaatgaccacaccatgtctcacacttcccgtataattcactgactcacgagacggatcaaggaattttttgaaagtcacattctgaaccctattcttgacagagccatcggcattgtaaacaaaatccttgtctatggtgatataatcgtgtttagcttcctctgcatcggacacactatatttagtaaagaaaatagccgtatctcccggtgagatataagtactgttcgtattgttacaaatccatgcctgctggaacacatcatcataacgggcatccatcttttcatcgaacaggttcagataatacagcgtaggcatatatctgttgaaactgcgaccatattctatggagcgcgtaacaggtttcttaccgtctttatcgagtacctgatcataacacatcacccacaacagatgtgaagggttattacccggtgtcctccaaatgatggggttcccgtcaggaccttcttcaatggaagttccgaatatctcactctttgtgtacatacaaacaaacacattctcttttacatcattacatttataaatatcacaaaggtccgaataatcttctgccaagctataatcataattgttaataacattacgagcatatttcaacgcttcctcataatttttattatacagataaacgcgtgccagaaacgcttctgccgcacctttggtagcacgcccgtaatcggaagtggaaaccggtaatttagccaacgcctcttttaaatcggctataatctgagtataaaaatcctcttcggacgaacggtaaacgtaacctgacggctcggtacattcttctgtcgttaaataaacacctccccatgtctctacaatatgccatagataaagagcccgcaagaaataggcttcccccatacggatatctttaaccgaagctgaaagttcagagctaggcaaacggttcaaggcagtgttacaagtattcaatgccgaatacaaacgttcccactctttagttatcgcattgctggaaccttgtaatgacgagttataatcggaaagctcagcttcggcacaaccatttccccgggtaaatatatccgttcccaactctgtcattgatgtggcatattcctgtccataccaaaaacgcaacggtgtgtaacatgagttaatcagagcttccgcacccgattcggttttataaaaagtatcagcggtcaatccgctaggattttcctctgtcaggaaatcattacatgagctcaaggttgccgccatacagctgagcaaacaccatttatataatttattcatacctgttcgcttgtttagaaatcaacattaataccaaatactgcttgttttgtcatcggatagctcaaggagcctcctcgttcgggatcataattgtctaaatgactgaaagtaaagaaattctttaatgaacaatagatacggatattagaagcatgaatcttcccgatccatgatttaggcaactgatatcccaaagtgatttctttaatcttcaaatacgaaccatccacgtatcccaatgcatctaatttggaagaatccgaataacttttttccggacggggaaattcgttagtaggattctccggagtccaatagtttactttaatacccggatctccctgaatacggtatgagccgtaaccgttggcttccgaatgtaacatttgcccttgtctccaatacatgaaaacgcgcaaatcaaagttcttgtatttgaatgtattgttcaaccccattacgaaatcgggagtttccgagcccaagatgatacggtcattatcattgtctattgaaccatccttattctggtcctttatttttatacgtcccggcttctcaccatacttagccgcctcctcagcttcgtcaagttgccagataccgattttctccaatccataatgtgtcttgatggaatgccctacaaaccaaccgttactgatatcacggtcagttccatctgccagctcagtaattttctctctgttcaaagtaaatgtataatcggtattccaagagaaatccttttgattgaaattttgggtattaataactaattccacacctttattctcagtttttcctacattatcccatgccaaagaatatccggtagaactaggtactttcttctgcatcaacaaatctgatgtcttttgttgataaatatccaatgaaccactgatacggttattgaagaaaccgaagtcaataccgatattagccgttgctgttttttcccagcccagattataattcggtgtcaaagctggatagtagccataggctccgttttccgtattatttatgagataagcatacatggtctttcccaatcctccctgagtctgataggcagaaacagcactgtttcccgaaataccataactcagccgaagtttcaaattggaaagttgttctacgttcttcaaaaaattctcttcattcatacgccaagccaaagccacagatgggaagaccccccactgatgatcttttgccaatacagatgaaccatcctgacgcaaagtcacagtcatcaggtatttctcattgaatttgtagttgatacgcccaaagaaagatgccatagtggtttgtacataactgctggatatctgctgactatcctgcaaaccacccaaattataaaacaacatagtggatgaaataaggttatgccccgcacccttatattcctcggccacatttttatataatgcgttaccagccatcagactcagattatgttttcctaatgtgaacgaataagccaatgtattttcccacgaccaattgacgtcactatgattggtagcatccgccaacgaataatttcccgctccgtctaacgtatatgtatcagcaaaatgtcctgtacggatatctttcttgtcaaagccaaaagtagaagtcattgtcaagtccttgataatgttccaggtagcccctacattccccaccaaatggctggtcagccggttatttttataggctccgggaacttcttcggctatggggctaatggtctgcccatcattaaaaggaagcacattgatagaaccatcttcattatatacatctccatagggagcgtaataaatagaacggttgaaaggatcacgtcggatattctgatccaaataggtatataccacattggcattcagtttcaagttatcagtgagcttatgcgataaggataaggttgcattataacggtccatatcatccatcttcaccaaaccgtcttcggacatatattcaaaagccagattgaatgttgttttctccgtaccatttgaaatattgacagaatgggacatctggctacccgtttgcatcagcatatccacccagtctacattttgattggattttaccgcatcataagcagaaccaaaaattttggcatcatcttcaggacctccccactggccgtccgtacgataagcctctctcttgaagtcggcccattcggacaaattcattctatcgggataagcagctacggaattgatggaataataaccgttatatgaaaccttggtcttgcctacagcccctttctttgtagtgatcaagataactccgttagcaccgcgagaaccataaatagcggtggaggaagcatccttcagaatttccatggattctatgacattgggattgatatcaatatctgtcccatagggcactccgtctacaataatcagcggagcattcgaagcgttcaatgaccgattaccgcgaatggaaaaggacaagcccgaacctgtctgaccacttgatttagtcatatccagtccagccactttcccttgcaggctttccaaagcattcgtcgtaggaacagcaataatgtccgcttgcttgatggaggtcatagaaccggtcaagtcccgtttctttacagtaccataaccaatgactaccacttcatccaattcttccgtatcttctttcaaaattacctttaccggagttcccggcttaatgacagcctcttgtgaaagcataccgatataactgatttccaattttttcgtgtccgcagggaccgacaaggagaaattcccctcgaaatcggtaatggttcctatagatgacttccccgccactttcacattagcaccgatgacaggctcaccggtactgtctagaactgtacctgttacggtaacattttgtgcataaacattcccgacactcatcaccaggaatgaaagcacaaacaaaataaacctactttgtttcatgttcttcattgttttcatttatagtatcatttaaagtttttagcactgcaaagatgaataaaaacaaaaaccggatattgcattattcagtctaagatttataaaatccggtttgagaataacaaaaacagagttatccgaatataaatcgatttaggctaacaggagggaatctgaaaatcccggcattctgtctttttgccattctaaacataatgaagaatccgaatacacacactattttgcgttaacagattcttcattacgttcaaaagaccaaagtaaaaagggtaatgcaatatagctttttgaagctttcttatttttcctattctatttcacttatagaaaaaagagtatttctacgctccatccgcacattttctccagttagctgacatgatgattccaaacggatatcagaagatgacgcacctattttaaatgtatattgaccaccggctatagtccatccattatttgcataataagccatttgctgaagagaaaccttaaaacttattattttcgattcgccggggttcaaattcacacgggcaaacccttttagctgtataggtttgagaaattccgaggaagtaggagacagataaagttgcacaacttcagtacctgcacattttcctgtatttttcaccttacagctaacctcaatcaaatcatcagttgtttgtgcagtagacggaacttttatatcgctatattcaaaggaagtatatgaaagcccaaaaccaaacggataagctattctttcttggaattcaccattgttataacaataaagttctttatcttcagtcttaggatagctaacgcataattttccggacggattgacattgcctaacaaaatatcaacaacagcatttcctccttcttcgcccggataccacgcttgcagaatagctgaacaacctgcttctacttcgtcaatcacttgtggacgtccaccaaacataaccagaacaaccggtttacctgtagcaatcagttcttttaaaaactgttcctgatctcccggcaaacagatacctttacgttgccgagcctctccgcataaggtaggattctctcctaatgcagcaataatcacatcactttccgaagctacatttatggcagcctgccagttagtagaatcggatgattccattaacatcatattcaagcgttcagttctaggatctccttcacggataatggaagtctcattttttgcactccaatcacatccgcgttcatagtccacagtgaatctaccattcgccttgtgcttaaaagcatcatatacagaaacaattttaggactgtcagggtctatttttcctccccaccagaatgcctgcatagactgatatgtataatctcctaacatacaccaatatgtatttgcgttcggccctaccaaagctattttcctatatttgccagagaggggcaatacattgttattttttaacaagacaatggattgacatgccaagttataagaagttttacgatattcgggacaatccaaatccaaatttcctgttgcatagagcttccggtctgtagataatacccccaaacgtgctttcaacattaatgcacgttttaccgcaatctcaaaatatttctcattaaccaaactgtcttctattaattcgggcagatatttataacaattatttgatggcaattcaatgtcattacctgcggttagagcctcaacagcccgttgtttcaagatatcaggatttcctttctgactagcatatcctactgccccatagtcactgaccactactccatcaaatccaagatatccacgtaatattttattcagaagagtatcgctggatacggcttgttcactacggaaccggccataggatgtcatcaagaccttacatcccgcctgtcgtatcatagcttcgtgtggcaaaagcacttcctcataaatttctttccaactcaaagaagagcctccaccatatcccaaaaaatgcttggtgcacgcagcaactccatttttcaatcctttcttctgcagaccttccacaaaagcgactcccatagctgcactaagatacccatcttcaccataggattcttctatacgtggccaatgagcggtacgtatgagatcgaccatgggtgacaaagcaagagtagcgccaacagagcgcatgacttccgccgtttgttccgtttttactgtagccagttccggattccatgtgcaggctatacccaattgttggggataaacggtcgctcctttggcagccagtccggtaatggcctcttcgtgaaatatggctggtatacctgagggagtctcatgtatcagataattttgaagatcacgcacaaaatcacgcagttcatttggttccatatctaaagcgcaagcatattgacaaatatgccctataccgtcaggtatcttctctttacacttttctaatgacaattttccatcctccattatttctttcggacgaataccatacaattgtgcaactctttcggcttgtgtcatcctactataaagcgtatctacttgcaggctcatttcccgaatgtcgaaatcctcaattgttttttcatgggttttagaagtacaaccgataaatcctaaagatattagtataaaacagtaaattgatatttttttcatatttgaatttatatcagaaaatattcttgtaaaatcaaagacaacttgaaataaaagtataagtctgtcccgcttcagtagctacatcatataaataagaatctttcaattccactcctttcaatggaactttctcactaaccagcggacgactgatttcttgcttttcaaacaagggattaggattatctccttccgctttaaccaatgtcataccatccatcgccaaagtattgtgcacacgtaagcgaagattaccaccgatagtagatttgataattgccgactctaccttgccgtctttccatttcagagaaacgatttcgaaaccaccacgtgcacgaagccccctaatctctccatttttccaggtatcaggtaaagcaggaagtaaatgaacagccccatcatggctctgcatcaacatttcagcaattccggctgcacaaccaaaatttccatcaatctggaaaggcggatgagcatcgaataaatttggataagtacctcctccctgacctttctgtacttcaggagaaacaaaattcaactgattggcaatcaacttaaatgcatgattcccatccaaacatcttgcccaaaaacagactttccatcccatagaccaaccagtagaaggatcaccacgctgtatcaatgtattacgggcagcttcaaaaagtataggtgatgaataaggagaaatttgataaccggggaaaagtccccataaatgagagatatgacgatgatggtcattagggttatcccagtcttcgaaccactcttgcaactgtccgtattgccctacttgcatgggaggaagttgcctttttaatgacagaatggtatcacagaattgcttgtccagattcaaaatctgtgctgctgaacgagtatttgaaaataaatcggataccaactgattgtccatcgtgatacctgcaaacagattggctttccctttccaaatactaggcgaattctctggagagttactaggagtgactaccagataaccggtattgggatctcttactaaaaaatcaacaaaaaattctgaagcactcttcagaataggatacacggaagccaggtattccttatcacccgaatagaggtaacggtcccacaaatgttgacataaccacgcattacaggtaggccacggtccacaataagccctatctacagcaccattcatacgccacaaatccgtattgtgatgcaatacccatccccggcaaccatacatctcccgggcagcctcctgaccgttctcatacaattctttcaccatttgtaggaaaggctcatgcatctcacgcaaattggtaacttcggcaggccaataattcatttccgcattgatattggtggtataacggcatttccaagcaggatttagtttctgattccaaataccttgtaaattagcaggttgtcctcccggctgagaactggaaataagcaaataacgaccgaactgaaaataaagagcaaccagatggggatcatcggaaatagcgaattcttttatccggacatcagtaggtttatcagcctgcgaagtgcgtcccaaattcagagatacacggttatagtatttttgatatgcactgatatgagcctgtaaagctcgggcataattctttccggcattcttcatggataccttattacgcccggatggatttccggatatatccttataattcacaaaattagtggccatggcgatataaatagtagcactattagcattagtcacggataataatgtatctcctgccacactctttccaccctgtaaatctaacttcaaatctgcacggaaacaaatagaaccttttgtgaaatcgtctcctttagttgtgccttccaaaatcaaggcattctttccagaaacggtaacatccaccttctgaggacaagtcagggaagcggaaaaagtaagttttcccggttgagaagcagtaaggcggacaatgaccagctggtcgacaaaagaggtaaagacctcacgcttataatctattccatttacagtataagcagtcgtggctacagctttttccaaatccaattcacgacggaagtttgtataattttcatgactaggaaagtccagacgcaagctgcccactgtctgatatggcatcccgaaaccgttcttggagaggattttttcacctgccaacgcttgagcttcaggatatctaccagcaaaaattaactgacggatggtcgccaacgctcctttagcctcaggattataatttttataaggagaacctgccgatactgtttcctcattcaattgaatctcttcggttacaggattaccatataccatggctcccaatcgtccatttcccaaaggtaatgcctcttcccaatatctggcaggcttatcataccataatacaggtttttcctgagcgtctatgctgatgctgactacagatagcaaaactacaagtgctatttttaataacttacgtgtcattttataattaaattaataaatatcatcgacttttataatggagaaagaaatccattctctatcaaccaagcttcagccaactccggccacatgaccgtgcttcccctttgtgcacgcaaagagatggcatgcccgccgacaggaaacagatgcaacgaagatttctctattcccgctttatacaaggctgtataataagcgatgctgttcaaaggagaaacagccttgtcattagaagcatgaaacaagatagccggtgccgtgttaccatccacttgtttttccaaagaaaacaagtttctgagagcgatatcctgttcccgctttcccaacagatttgtccggctccctttatgaacaatagcgtcatccatagaaataaccggagatatcaatacagcaaaagaaggtttacaactatatgcatccagtgcatcgcccacttttgaccagtcttcatcaatagcacacaatgaagcggccagatgaccgccggcagaacaacccatcactcccactttatgaatatctattccatattcctccgcatgagcacgtatatagcgaagagcacgttgtccatcctgcaaaggagctttgtaagattctattacatccggtgattgcgggaaacgatgtatcaggacaaaagccgttactcccaaggtattataccattttgccaatgcgataccgctgatttcatgcgccagtttcacatatccgccaccaggaatgatcaataccgccgtaccggtacgctcggcttttgacggttcataaacatgaacagcaggaattccgacttgtaccacacgttccctgactacagaatctttaagaactatacctttgctattgggcatattattctgccacaaaggaattattttctgagcctgaagagtaaccgtcatcaatgccatcaaaagaaaacctaataaaaatacgaatctgttcattactttatactcctttaaaatcctgtccatttactgttacattctcaaagtgaatgttttcaacaccagtcaccttatttatttccggtttcatcactccatcaaaagtgcaatctttcacaaaaatatctcgcgcctgtattttatcctcaaaaccatccagatgcaaaacatactgacttttcttacttgtgatattttccaaatgaatattgtgaaaataaggaagatacggtccgtcatccacatgccaatatttcaattcaaagcctaaaatagactccttacattcacctaccctaatattccggataaatatattttctacttcgcctcctcgcatggcatttgattttatacggataatacggtcgagttcaggactgtccatggtacaattttccacccatacgttacggcatcctccggtcacttcactgccaatagctactccggcatgaccatccttcattctacaatgacggactataatattctcactggggatattccagtaacggccatcttcatcacgtcccgatttgatggcgatacaatcatcacctgtatcaaaatcacaatcctcaatcaatacattcctgcatgattccggatcacaaccatcattattatagccatgactctgcattttgactttcctgacagtgatattctcggacaacaacggatgaataagccagaacggagaacggttgagagtaaatccttccaatagaatattcttacatttatagaggttgataaactgggggcgtataccattctctctcataaagacacgttctttaaaaggaatagaatcctctttcatttcatacaacaaagttttctcatttattttcttaccatcttcctgtacaataccacgaattctgttttcactgagccaattactgctatcagcctggccatccatcaccccgttaccagtgatggcaatattagtttctccataggcataaatcaacggagagatattgtaacaatctattccttctatgcgagtctgcacaaggtcgaagaagaagggatctgtagtaaacttcagtaccgtactgtcagataaatgaaggtttacattggatttcaaacggatgggggctgtgagaaactctccatcgggaataataactttcccacctccctgctcagaacaaatagttatggccctattaatggcattcgtataaagcgtgtcttttacgtcgtgataatccgtaatcacgaaacttccctcagggaagacaggaggtacaatttgattattaacctcggtcatttgattccacggagatacttcttttttatcacatgaagatatggctgttgtcagaaacagcaaagataccaaaatttgagcggttcttgtctgcatagtattgtattatgtttataattctatgcaaaaataggacaagatacctatacagccattgcagtatttggggcattaattatacattttgttcaacaatcgttttatgctttaatctgtactcttttggtgtacatcccattgcttctttgaatactctgctgaaatattgcggagtagtgaatccactcatatatcctacttcagatacagtaaattcatcttgttccaaaagttggacagcccgtttaatccgcatcgtctttacaaaatctacaggagaaactcccatcaaagatttcaccttccggtagaatacagtccggctcatgctcatagcttctgccaaatcgtcaattttaaattcagaattctgaatgttttcctccacactctgaagaatattccggatgaaatcattatcaaaatgagtaacttgaggagtagaaggagtaagttgttccataagactagtatctttctcgccttctctcatctttgaaatgtaataatcatacaatatttgccgttgtttgagtaaggaatctactctggctttcaaataagcagaactaaaaggtttcgttatatattcatctgccccgtattccagtccttggatttggtcattcaaagaagacttggcagataacaaaataataggaatatgacaaatatcattgtttcctttaacccgtttcagatattctattccatccatttcgggcatcataatatcactgatcacgatatcgggtaattctctcaacgtcatttcaagtccttgacaaccattacccgcttcaagaaccacatactccctagcaagcacaccacagataaaatggcgaagttcttcattatcctcaataatgagaatccgtgtttccttatcttcttcctcttctgtaagcttatcgggtattgccacctcctgtccggaattcttgctgtccgctagaataaattcaatattggcatcggcatcgaaaacatcacggttacccggcagtctgataaagaaactgctaccttcacccagtttgctgtctactctgacagtaccatgaagcagattcagtaattctttgaccaatgaaagtcctataccggtagacatattgggatcaatctcatccaaagtatcaaaacgggtaaacagacgattgagcttttgggcattaatacctctaccctcatctttcacctgcaaacacaaaatctgtttctcgcaagtaacagatagggagatacttttctcatcaggagtatatttaaaggcattggacaataaattaaaaagaatcttctccaatttgtccacatccgtatacataacaaaggaatcgagaggacaaaacaacctgaaatcaatacgatgcgtatgagccataggaacaaaattaccgtagatttttagaattaaagggattatatctacttgttccatcaatactttcatcttgtcattctgtatcttgcgaaaatccaatatttgattgatgagccgcaacattctgtctgtgtttcttttggccacttgcatattctccatgcctgcatcagataatttctcattactaatgacttcgtcaatgggactggctataagcgtcaacggtgtacgaagctcatgggatatatcagtaaagaaacgcagttttaagttggaaatctgttgttcaaaatctatccttctttgcaggttagtaatgcgtaacacaatgcagatcactaccaacataatcaccacggccatggtgatatagagcaataccgcccaaacagtttcaccgaacacaggatcaatatgtacggacaaagatgccacattatcaacccataccccatcggcattagtggatttgacttgaaacagataatcgccggcaggtacattcaccaaactggcagaacgattatttccaagctctatccattggtcattcagtcccttaattcgatatacgtattttatagccggagagttaacatagtccaaggcagcaaaagttatagtgaaattacgttcatccggctgcaggtactgagcctcatcgttactatatatgtcctgcctgcgagaagtattattctgataaatgtcaagatgggaaaaaacgataggaggaacgaaatcactcttatgcaactcatcgggaattatacataacgcaccatatagtgaccctaaaagcaatttaccagaagatagcaaaacaggcctagtctctgccatctgtatctgatctttatactcttcgagcagattcaggccagcatcaaatttggaaatcttgttttctgaaactatccatatatttccttcttgatcctctatgctggacagtgacaaatccggtaatcggtcattagtggcattgtaatgtttaaagttcaatctttcagataaactgctaccatcatccaaaatattaataccaccactcaaagtagttaccagcagtttaccacccttagtttgggttatatccaatatatcattattgctcaaactggaataacgctcatcacaaacattatgaaaaaaacgaatctcttccggacgggaaaaatctgtagaacaggacagcaatccgccagtagtacctatcaaaatcactccatcagccacctcatataaacaacgcactttctcacatacatgaatggggtaattattgagaatattaccgtaatgaacaaacttcaaatctcctcctgcggaagcagactcaaccaaattgatacctccaccgaaagtgccaatccatattcttccagacgaatcttgcaaaatagagaatatagacttggaagaaatgctgtaaggattatctttatcaggcaggtaacaagttacctgatagttgtcctccccttgaaaacggaataaaaacaaaccgtcttctctagtccccatccagatgttatgatccttatcttcgtaaatacagtacacgtcagcattaaatgagacagactgatccgccactatttttcctttttgcgaaatatttcctatccactgtcctaacgaatcataaagacagatgtttcccggttgagttttatgattccgtttccaaccaatccatacacgtttgcgatgatcttccatcaacgaacgagcagactctttatgtctgttgattatataatccaacccactttgatgaaaagaaagatatcctaattcacttcctggagtggtataccacagatttttatgatgatcaataaaatagctgaaagcctgaaatgagattggtactctcactcctttttcataaacataagcctgttccaaagatctagtcatcggatcataaaagtataactcaccttctacaggattcacccaaatacaaccatactcgtcctcatgtataaaagtacagggcttggtaaaaggaacttcctttaacttaggataacttaataagataatatcctcagtagtacaatctaaacgaataaccccacccgtgccccccagcaaccaaaaaataccttttctatcttgatatatatcaggactgatctctacaggcattttataaagagtaaacttgcctgttttcggattataaaaccgaatctcttttctctgtaaaatagcgattttatgatcagataaagatttcagtccgataatctcagacataggttcattggggacacatggaacaacattttgactctgatagtcatatcgggcaaaaaagccttttgaagtagcaagatagatatcatctgcattctctaccataaacttaaaaggcataagatttgccatactcttctttcctacaatcgtagctcctttatttgtcagaatccattcatctccatccttgtcctgcatcacaatatagatactgtctcctatgttattttctatttttccagtatataattgcactgactccgtagcaggaaatctattttcatccaaacggaataactcattttgtacacctacggcccatgttatccctttacgcaatacatacagtttttcaactgagtttatcacccctttgttgaaaagaaagggatcttcatactgacaagtacgggtattaaacagataacaatgtttatcatacgtctgacaccaaatattattcagagaacttttttcaatattggtaaaacgatgatttgttatacgtacatcactttcaggataagttttataattagtaaaagaatatccatcaaaacgctctagtccgttccacgtagccatccatatataaccattatcatcttgaatgaaattctgaatatttttctgtgataacccatcctgaactgaataatatttaatatcaatcaaactctgaccaaacaaaggcaaggcagaaaaatacaaccatataagaagaatctgtttcaacatagtatttacctttttcaaccacacaaatatcggaaaaagatgtcacaaaccaatagcctgaatagttattacaatgattagacctgtttttataagaaattctaccataagtagcaatatcacaccataacctcccctttcaaaagaactctgccgaagtatagcttcggcagagaaaagaacaagatgaacgtctatccagacattcacaatgctaaaccataaactgatctttaaaaattaacaattcattattctgtccagtcctccactatagccgaaggatccggattcaatataatagcttggttattaatagattcaaacttactaaaaaataaattgaaccatggacagcaatatccttctttagagttcatacgataccccaccggacaattggtacctagatacccccgtgtaacaggcaattctaaacgcttataatcccaataaataataccctctccccaaaattctatccttttttgcaaaatcaattccttacgaaaatcctccatagtagatgccgtacattgataggaactgtaacgataagttttcataaaattctctaaagcagaaattccagcacttaccccctgactagcggctattgcctcagcctcaataaaatacatttcttcaacacgcattaaaagattatctatcggtgcacctacattggcgtcaatcatattgccttctttcggcttgaattttaaatgaacatatgcaggcacctttttaaaattctcatcggtgaacaatgtatgatatttagtacctggagcctttccagcatcttcaggagcaatccaagtttctttgcgccaatcatcatccgagatttgctcaaataaaaccttactgatcattctgtgtgccccataggaaattcctcctaccccaaatgtctgttctgtacacaagtgccctgccaaattaagccatacactgtgaatattctctttattcatgattcctccccacatccatgcacttgtctgaatagagttaaaggccgtaaaatagtcttttccaccataccattccaattctgtcaatggagcagcaccacttttaactatagcctgtcttgcacaatcggcagctttaatataacaatccttatccgaatctatatctaaatccacattctggatcagtgctgccaaatcattagaatacttttcaaatcgcgtacccaattctagccaaaaacgagcttttaatgcaaatataatggacaaatcaggcatattcttagtaggcctcaagtaatcagctaatagaacttctgcattctccaaatcatccaagatatatctgtaaatagtataaaaaggaacccgcggattattacgtgcttctgcttccgttatattctcaccaatgatagggactgttaatccatataccccattggtagcagcctcgtcatccagcttagaaaatccagtcttcttaaactcaaacagacgagccatatccatgtaaatcatcgcacgaaaggctttggctattcctacatattgcctatttgtttctgtagtattatcaagatccacaatacggattaaattattgacattattcaaaaatttatagtagtaataataaatagaattcacctctgaattatcagccaagctacggcacaatccgaaagaattataataatcataaccagatttatatatataaaaatcctcacacataacttctcttataataccgtatgaggtatagcccaagtcccaagtataaccttgtccataagtattatatgcattaacaaagcctaccacggcatttaacatagcattcatagcagctggtgattctgcaatctgctcggaaatagcggtagagcttttgggaaaggtctgttcgatacaactgctcatatttatacctgtaccgaaaagcagacaggcaactaccgctgtttgaaataatatatttttctttttcatcgtcttaaaatttttgattataactaagttagaattgaagactgatacctccggaataagtacggaacggagctatctttcctgatgtacctactcctgaaatggaacggcgaggatccaagccttttctttttgaccaatagtatacattatcgcaaacaaaatataaacgtaaatttttaattttcaaatgagaagtccaactatcaggtaatgtataccccacttgaatattttgtagattcaaatagcttccatcaatcagaaagcggtctgacgaaccagtcgtattcagatcattgaaataccaacgtggaatggttgatgagggattttctggagaccatgcctttagcacatctttatgccaacggttacctacagatgttgcagttgggttacccatcatacctgcataaccgtaatcataagtcaaaccaccaaccaaataggaaaattgagtagagagatcaaaaccatggaaagtaatggaagtgccaaaaccaccatacaaatccggattaggatctccacacaaataaaagtcgcctgtagaataagtggtcgttgttttttcctcattggtttctttatccgtataataccacagtgaaagtccgtcctcagacaaaccggcaaaacgtttcatataccatgtattgataggcagatcctcaccataatatctgcttccattcatatatcctccatgaccatccataacagtagtctttttctcatctggcaaataagtaatcttattcttatagtgtgtcagattcagatttattttccatgtaaaattctttttattaacaggaatatagttcagttccagttcaacacccttattcgccatatcgccgatattatcatagtacccaggataacccaaagaaagaggaacattgaaccaatttaacatatcagtagtcttacgataaaacaattcaacaccaccattcagttttcctttaagcagttcaaactcaactcccaaattcatgttagtattcgtttcccaagttatatcttttttccccttactattaaaagacaatgaaagttcatcattactattcactatattatatctgtctgtataattatatgaacctatattatcattaccttgctgtcctatggagaactttattttgagcatatcaatccatttcacatcaaaccagtcctctttagacattagataagcaccgcctacagaataaaaattaccccaccaatgatcaggatgaaaacgcgaagaagcatcacgacgataagaagccgaaaaataatattttgcatcgtaatcatataaagcacggaaaaaatatccctccgtattataatcattcgaataagaagcagcacttgaaccatctataacagccccattcaattcatggtttccccaatatgaaaacatatttttcttggatgcggataattctgcataattatatttataactctcatgtcccaacattaccgaaatattatgtttaccaaaattatggctataattcaatatctgctgtaagtttaatgtagtagtacgataatgatacattgtcactgtgccattctgttctgcaccaaaaccataatatggatttgttgtagtataatatctgatttcattaactgtggttcccacattaaatgtaaacttaaaatctttcaaaaaagtaatatctacaaatgcattaccattaaatgtattaccattcctattttcttggttaagcatagatgactgaatagaagaattaggatggttaggacgtgccaatcccagttgtgccgtcgctgttccataatcatatactttcccatttaaatccgtcagaatatttccatcagcattcctcacatatacaggatagattggtgccatgccctctgtaaagctggataaatccgtatcatacttttctgtcaaggaagcactattactatgtgtataactgatgttagcaccatatttcatccatttttttgcttggtacaagcctttaaaacgagcggaatatcgttcataatttgaactaggaacaattccatcatcttttaaataaccaaaagaaccatatgattgcatcttatcggttcctccagcaatattcacattatattcttgacgcaaggcagaactataagcttcatcaacccaatcatccggataaagcatatatccattaaccaccctgcccaaagttgcattgggattcagctttccgttcataccaataagattttcgttttcaggataactatacacattataagtcaaaccaccattttccttcgtattacccaccatatttttattagcttgagcataagcctctccttctgaaagcccctttacatacctcaattgattatataatgccttataatgtgcttcataatattcacccggatctttgatatagtcataatcaattgtaccacgagtattcactccccattttgcactagccgtaacaacagcttcaccagcttttgcctgcttggtagtaataataataacaccattggcaccacgtgcaccatataacgcatttgatgctgcatcttttaaaacggacactgattcaacatcagatgggttgatattgttccatcctccctcatagggcataccatctacaataataagtggatcattatccgcattgatagaaccaataccacgaattatcaatgttggagcatctcctcccggctgcccagatccacttgtcatttgtaagcctgccacttgtccagcaagtgcctgaacgacgttcgttgtctgtcttttagaaagtttctcagcatttacaactgaagccgatccagtaaatgccgaccttttggctgtaccataagcaacaaccatcacttcatccatcatttcagactctgtaaccaatactaccttgacaaaagatttaacatcaaccacttgggtcttcataccaataaatgaaaccattactttcttatcagttggtttaatattatccaacacaaatttaccatccacatctgttatcgtaccatgtgtagttccctgtatcaacacagaagctcctactaccggcaatccatcatccttggaaagaacaattcccgacattttggttacttgagccgataaatggcctattacaactaataagcacattaaaaacagaacaatgcgttttcccataccatttagattttttttaataggtttaatatgatggaaacaaatatattaaatataatcgatgaataaaaactttattcactttttttctttatattttttaaaacgataagtgttttgtgcaaaaattacataataaaagaaaatatcaagcctaaattatttaataaaagaagtatcacttttttaacttcaagaataattctagtatgtagaaatcgaagtttccaaactgaaccgagatgtgggaagcgttgtagaattttcaaactgagccgcaaatatggtgcaatttactaaaataaaaatcacaaatatctaataactagatatttgtgattttattttgtactcgaagcgggacttgaacccgcacagccgcaatggccaagggattttaagtccctcgtgtctaccgattccaccattcgagcatcctcgacgagagagagcggaaaacgagactcgaactcgcgaccctaaccttggcaaggttatgctctaccaactgagctatttccgccttttgttttaacggatgcaaagataagtcattttataataccaaccaaactttgcacccatttttttatttacaatcgtaaaattccctctatttcggccaattcttcattagtaaagttcaaattatccaatgcatgaagattatctgccaactgtttcacagaacttgtccccacaataacagaagtcattcgttcgtctttcaagacccatgccaatgccatctcagccaaagtctggccacgacgagcggctatttcatccaaccgacgtgcttttcctactttatcttctgtcacttgatctactttcaaaaatccggtagaacgggccgcacgagaatgttccggaataccatgcagatattttttagtcagcaagccttgcgccaaaggcgaaaatgcaataaaaccggagccttgttctgcagccaatggcaatgatttctcctctacagtacggtcaaacatactataacgatattggctaatgagacacggcacaccggcagccctcaacatttcataagctattttagcttgtgctggagggtattttgaaatacccacatacaatgcctttccttgtttcactatatcaatcaatgcctgcattgtttcctcaacaggagtcaccccatcataacggtgactatagaatatatcaaagtaatccaaaccggtacgacgcaaactttgatcaatgctggccattaaattcttacgcgaactgtttcctccataaggtccatcccacatttcatgccctgcttttgaggaaataatcaattcatcacgataaccttgaaaattttcctttaagattttaccaaaattaatctcagcacttcccggaatggggccataattattagccaagtcaaaatgcgtaaccccattatcgaaagcgtatttaatcatatcggttgccacaccgaaatcgtccacactgccaaaattatgccacaagcctaaagagatacgaggcaaaagtaatccgctattcccacagtatttatactgcatcttgtcatagcgctctgctgaaggttgatatttcatgatcatgcgatttataattgtttctatctacccaaaagggattgttctgcctgctccatgactgagaagttaaaaccatctactacctgttgcatcagattttcaattctgtcattacacaaattacctatactaccctcatgagtatgatgtaccttcttgttgtgagtaaattttccggcttctatatccaagcccaccttcttataagcatcacggaatggcatgccctcagaagccagacggttaacctcttccacactaaatatataaaggtaacgatcatcatccagaatatgctcgttgattttaatcttgtccataatataggcagccatttgcaaacactccttcagctcctgaaaagcaggcaggaatacttcttttataatctgcaaatcacggaagtaacccgaaggcagattgttcattatcatcataatttgttgggggagaacctgtatcttgttacacttagcccgtgtcagttcgaacacatcgggattcttcttatggggcataatactggaaccagttgtacactcgtccggaagtttcacgaagccaaaattctgactactaaacatacaagcatcaaaagccatcttagaaacggttccggcaatagaagccaaggcaaaagctacattacgttccattttgccacgtcccatctgcgcatataccacattatagttcatcgaatcaaaacccagcagactagtagtcatctcacggtttagcgggaaagaagaaccataaccggcagcagaccccaacggattacggttgcacattttgaatgcggcctgcagaaacatcatatcgtccaccaaactctctgcatatgcaccaaaccacaagccaaatgaagaaggcatcgctatctgcaaatgggtatatcccggcatcagcacatctttatattgattgctttgagaaatcagcacatggaaaagccgctctactgcttcggccacttcttttaattccgcacgagtaaacagcttcaaatccaccagcacctggtcattgcgtgaacgtccactatgaattttcttcccgacatctcccaacttacgcgtcaacatcaattctacttgcgagtgtacatcctctataccatcctctattacaaactctcccttttcggcagaagcatagatattctttaattccgctaacagcatttccaattctccggccgtaagcaaaccaatactttccaacatggtgatatgtgccattgagcccaatacatcgtgtttagccagataaaggtccatttcacggtcacgtcctactgtaaaacgatctatctcctcatttactcggacatttttttcccaaagtttctgtgccatatttttctttattttttaataaggaatcatcgataacatctcagccagtttatccaccccatcctgtaaaggtttagtaaccatcgccttcataaacatattcacttctgcacgaatagttactttcagttttgcctgcccagcctctacaggcaaaatctgaatccacaaattcatagggaccggagatttttcactttcgaatttaacacatttacaaggttcacgttctataatacgcaaagtaatgcttatgccttgtaccgtaaaacttaaagaatcacagtcgaactccataccttgtaccttgtcagccaatttatcacgtacagattccaagttacttaaatccgacaacttattaaacacctgctcctgactataaggaacatatttcacactactctcaaattgtgccataatacctgctctctaaaaacacgaaaagaacaatccggaaatccataaaaatttccgaacggttctcttcatattatatttgttttaaaactataacttatttgcctgcctcccaatgagccggatcctttctccagttatctaaaacagaaacatcctcttcattaatatatccggttttcaaggccgaatccaatacagcttcataattagtcagagtaaccaagttcacttttgcttccttgaacgcttcaattgccaccgggaaaccataagtaaatgcagcgaccataccaatcacttcacatccgtcacgacggatagcttcaacagctttcaagctactgccgccagttgaaatcaagtcctcaataactacgactttcataccaggacgaagttcaccttcaatcaggttttccaagccatggtctttcggagtagaacgaacatacacaaacggcagattcaattcttcagccaccaaagctccttgagggatagcccctgtcgccacaccggcaatagcatctacctgaccgaacttctccaggacaatacggctaatctcaagtttcacaaaattacgaagagaaggatacgaaagagttttgcggttatcacaataaaaaggcgacttccaaccggatgcccaagtaaaaggattagccggctgcaacttgatagccttaatcttcagtaatttctctgcgaataatttttctaaagtcttcataactcaactatatctgataaatattgtgcaaaaatatagaaatacatcgagataatgaaaaatcggacaaggtatttttctaaaaaatagttgttgttatcaagattcccctgccaatgccaaagtaagtacactgatacgtaatccgggtatgccacgaaaggcatcagcgcaagaaacaaccgtagcccctgttgtcagcacatcatccaccaacaatagatgctttccttccaagccatcggggaaaatacaggcaaacaaatttcgcacgttttcccatcttgcatattgtcctttatgcgtctgcgtatcagtatatctgcttcttatcacaactttagtgttcataggaatacctgtcaccaccgaaactccccgtgccaagcattcactctgattatacccccttaaacgttttttacgttgatgtaacgggacaggaacaatcaaatctatcccatcaaaaaaatgagaacacataagttcagatgccatcatccgccccatcacttcacccacttcttgattaccatgatatttcagttcatacaacaactgtcggacattccctccctttgcataataaagaaaagaggtggcacgctccaccggtatttttccccagaagttacattctacaatattatctttccgtaaatgaaattgagtacgcggaagccttgacaagcatttcaagcaaagcactctctcccctgatataagctgccgcccacaaagcagacaactatgtgggaaaaataaattccaaagatcagtccaaatagacatcatcttctccggtttgtttcacacaacggcaaacagcctctatttcaaatcctctaccaacagcaaaacgaatcaatttcccattccgttcgtattccgtacatgctttcactctacttcttttctgctcgatcaagccagacagaatctccacatactcccgttcatctatctcctccaacccttcggctataacatccgcagggatcttcttcatgcgcaaagcctgactgattttcactctgccccattggttaaagcgatatttatcacgaacaaaagccgagcaaaaacgcttctggtcaatgtatctctcatcctgcaaataccgaacgattttctccatcacttccggagttgccccccattgtgataatttagcctctacatccgttacacaacgttccattgaagaacaataagcttctgccttatacctcaactcattctcacttaattctcctttcatctcatttttccgcttttatcattctatcattttgaaagagatctttcctcaattctatatttttgtatcccaaaccagctagcatatccaccgtctcccggccatattcctgattaatttcaaaataaagccttccaccagacactaacatacccctacccaattctgctattttccgataaaacagcaatggactatcatccggcacaaacaaagccaattccggctcccactccaagacattagcactcatattcgctttctccttttctgtaatataaggtggattgctgacaatgacatcaaactgctcaccggcaggagaagcaagcagcacatccctttgctcaagagttacacgaacgccgttccgcctgcaattacgttctgcaacttgcaacgccttttctgagacatcccatgaaacgacctccgcctcttccagattcttggtcaaagaaacagcgatacaaccactccccgtaccaatatccaatattttaacccgaccatacttatgttcccgtataatccaatctaccaactcccccgtttccggacgtggaatcaatacatgtttattcacttcaaaagtaagaccataaaactcttcagtgcctattatatattgaataggttctagtttttgcagacggaccagaatatcatccaaccgtttctgctcattcactgaaaaagtagtatctttgcctgcatacaattcaacaacagacataccgaagacttgtgtaagcagcaatttagccataggtacaagttctgtatcggggtaatacccctgcaaggtttgttttatgtaagatacaacaggattcatagtgtcattttatatgcaaaagtaagaatttaaacaagactgttatgacaaaagatgaaaaatatatttcccgttgtctgcaactggcacacaacggactctgtaacacagctcctaatccgatggtaggtgctgtcatcgtatatcacgataccattattggagagggctaccacatccgttgcggagaggcacatgccgaagtaaacgccatacgttccgttaaagacgaaaatctgttgaaggaatcaaccatttacgtaagtctggaaccatgctcccattatgggaagacccctccctgcgccgatctgattatagagaagaaaatccccaaagtcgtgataggctgcatggacccgttttctctggtagccggcagaggtatcgaaaaactgcgcaaagccggtattgaagtaactgtaggtgtattagaggaggaatgccggcacctgataagacgcttcattacattcaacacactcaaacgcccatacataaccttaaagtgggcagaatctaccgatggtttcatcgatataaaccgcacaggaggaaaaccgatcaaactatccaatccactgaccagcatgctggtacacaaaaaacgcgccgaacatgacgctatattagtaggacgacgcacggcattacttgacaatccctccttatccacccggaattggtacggcaagcatcccgtacgcctggtaatagacaaagaattgacattaccgcgagacctggaacttttcagtggcaggataaagacattcgtgttcacccgaaaatccccccatcagccaaacacattaacagaatacatatctttggattttagcaaagacatcctgccgcaaataatggaagtattatatcagaaaaaaatacaatcacttctagtagaaggaggaagtattttattacagtctttcatagattccagtctatgggatgaagccttcatagaaaaggttccactgtgtttgaagaatgggatagaggcaccttctattcaaaaaaaatactttaaattgaataaaatatactttggaagagaaataatgcatgccgtccatccacaaaaccaaagacaaaatgtggctgattgacagagaaaaagggctagtttatctataaattaatataaaacttgccctaaaacttctgtatagaaaaaaatcttcctacttttgcgacttgtaacaatagactcatttgcaaatgaaaataaagtttttgactgtcatcacaagtctgcttactgcagcttttatgattacatcttgcttggacgacaacgaagtagaaacagaatatagttcagaatcaagcattaccgcttttgctataaaagataaaattgaaactcaatataccgaaaaggttaatggcaaagatacaacgctgacattcaccgttgatggtaccaaatacccttttgccattgaccaaggcacaagacatatctacaatgtagactccctgccagtcggtacagacatcagcaaagttgtagtcagcataacatcagatggtatcggagtttttattgttgcagaggacaaagattcgttgtggaatgaaaccgactccttgaatttcgaaaaacctatccaatttaaagttatggcaatgagcggagtctatgggcctatttataaagctgagattaatgtacataaacaagttcccgactcattgcagtggagccatagaggaagtagtttcgacaacaccatccaggcacaaaaagcagtcacattaggagattatatttatgttttcgcacagcaagacaatggtgccgctgttacaagcacccacatcaatgatggaggaacctggacacccttacaggctttacctgaaaatatgctaaatgcggactattcttctgccatggcatggggaaacaaattatacatacttgccgacaatgacctgtactgttcctctgatggaaaaagctggagcaagattggcactaacaccaaattcgagaagctgattgccggcgttcattcagaatataaccgcaaattgtacgccatagacaccaacaatcattttatggaaagtacggatgctatggcgtgggatactaatggagaggttccggccaatttcccgaaaaatcagatatcatacacagcttacccgttggtaaccaataaatccatagaccgtatggtactaatgggggaaaatcccattgctaccgacacgacctctactgtatggaccagactgaccacagaagacagttgggcagattatcctacagccgcatacgatagtttttattgtcccaagctggctaatatagccatgattcattacaacgaccaattatacgctttcggtggtccgggcaaaagtttcggtaaggacattcccgccttcagccaattctatgaatcaacagatcaaggcgttacatggaaacctgtttctagatatgtatttttcccaacagaattccccgatctataccatcaggcagacggcaactattcttatgttatagacaaaaataactttttgtggattatatggagccgaagtggagaagtatggaggggaagaatcaataagttgggattcgattccaaggaataaagtcaaagagagtcatataaaatagattgcgacatgccatatagagagcaaatagacaaaagccgtatacctgcccatgtagccattataatggatggaaatggaagatgggctaaacaacgtggacaggcacgtagcttcggacatcaagccggtgcagaaactgtacacatcatagcagaagaagcggctagactgggagtcaaatacttgacactatatactttctctaccgaaaactggaatcgcccggtagatgaagtcgctgctctgatgagtcttctgatggactccattgaagaagaaactttcatgaaaaacaacatcagttttcgcattatcggtgatacggcaaagttaccggtagaagttctggaacgattgaaccaatgtattgaacacacctcaatcaataccggcatgtgtctgacacttgctttaagctactcttccaaatgggaaataacagaagcggtaagacaaataacgatcaagattcaaaacaacaaactagccattgacgacatcgatgacaatttgataaatgcgcatttaagtacaaactatatgcccgatccagatttgcttatacgtaccggaggagaaatccgccttagcaactatctgctttggcaatgtgcttattccgaactatatttttgtgaaacgttctggccggatttccgcgaagaagaattttgcaaagccatttatgattatcagaaaagagaacgccgtttcggcaaaaccagtgaacaaatataaagttagataaaatgctatatcgtatttcacttatactattaacgcttacatgcctattttgcttttcaacaggcagttacgcccaagaagcaaacgtagaagaaaacgacaatccagtcatactttattccggaacgcccaagaagtatgaaatcggcggaatcaaagtagaaggcgtaaaaaactatgaagattatgtattgatcggactttcaggactatcggtaggacagaccattgttgttccgggagatgacattaccacagctgtaaaacgttattggcgacacggactgttctctgatgtacaaatcatagctgaaaaaattgttggagacaagatctatttaaaaatcatcctggctcaacgtccacgtattgccgacattcgttaccacggcgtaaagaaaagcgagcgtgaagatttggaagccaaactaggtttggtaaaaggaagccagattactcccaacttgatagaccgtgctaaaatattaatcaagaaacatttcgatgaaaaaggttttaaaaacgccgaagtgactattgtagagcgtgatttggctgacaataaagaccaagtggatgttgatgtaatgattgacaagaaagaaaaggtgaaagtccacaagatcaccattgacggcaacactgtgttgagtgacaagaagttaaagcgtgtcatgaagaagacgaatgagaaaaacaaacttgtcaacctcttccgtaccaaaaagttcattgaagagaaatacgaagaagacaaacagcatatcatcgacaaatacaacgaattaggttaccgcgacgcacaaattgttgtggacagcatttctccatacgatgaccgtaccgtcgatgtgtatatgaaaatagaagaaggtgacaaatactatctgcgcaacgtgacatgggtaggtaacaccatttatgcttcggactggctgaacgagcaactccgtatgaaaaaaggagatgtttataaccagaaattaatgaccgagcgtctaaccggtgatgaagacgctatcggtaactactactataataaaggatacgtattctacaaccttgacccggtagaagtaaacatagacggtgactccattgacttggaaatgcgtattcaggaaggtcctcaggcctctatcagcaaagtgcgcatcaacggtaacgaccgtttgtatgaaaacgtggtacgccgtgagttaagaaccaaaccgggagatctgttcagcaaagaagcattggaacgttcctatcgtgagatagcccaaatgggacatttcaaccctgaaaatatccagccggatgttcaaccggatcctaccaatggtacagtagacatcaactggaatctggagtctaaagcaaatgaccaggtagagttctcggcaggttggggacagaccggtgttatcggtaaattaagtttgaagttcacgaacttctctatggcaaacttgttccataagagtgataactaccgaggattcctgccacaaggtgatgggcagacattgaccatcagcggacagaccaacggtagttactaccagtcatatagtgtatcgttctttgacccgtggtttggcgggaaacgtccgaattcattctctgtttcggctttctactccatacagacagatatcagcagtaactactataactcagcttatatgaataattattataattattacagcggttatggtaattattatggtggatataacaactacgagtcttattatgaccccgacaaatctatccagatgtatggagcatccatcggttggggtaagcgtttgaggtggccggatgactactttaccctgtcagccgaactctcttaccaacgatttatattgaaagactggagctacctgtatatcaagttgaacaacggagagtatatgtcaaccggtaattgcaacaacttgagtttgaatctaactctggcacgtaactctacggacaacccgattttcccgcgtcgcggttctgaattctcggcttccgtacagttgactcctccgtactcattgttcagtaacaaggactactcggtatacggtaaagatgattatgatgaagctgcaagcatgttcaactggattgaataccataaatggaaattcaaatcaaagacctataccgcccttacaggaggtcagaaatgtccggttattatgacacgcgcagaattcggcttgctgggtcactataacaaatacaaaaaatcaccttttgaaacattctacatgggtggtgacggtatgacaggctatagcaccagctacgcttccgaaaccattgcactgcgtggttacgaaaacggttcattgaccccttatggtagtgaaggctacgcttacgtacgtttaggtgcagaattaagatacccgttgatgctggagaattcgaccagtatctatgcgctaggcttcatcgaaggaggtaacgcatggacagatgtaagcaagttcaatccgttccagttgaaacgctcggcaggtgtcggtgtccgtatcttcctgccgatgattggtatgatgggtattgactgggcatatggtttcgacaagattaacggctccagccgttatagtggaagccagttccactttatcctaggacaagagttttaataactaaaaacaaagtgattatgaaaaaggctatcctattatctctattgtttgtggcttgtgtattcacagccagcgctcaaaagtttgccttgattgatatggaatatatcctgaagaatattcctgcatacgaacaggcgaatacccaactgaatcaagcttcacaacaatatcaaagtgaggtggaggcgaaagcaaaagaagcggaaacactttataaagaataccagaaagcctcggcttccctgtcggccgcacagaaaacgcaaagagaagaagcaattgtggcaaaagaaaaggaagcagccgaactgagaaagaaatatttcggtcctgaaggagaaatggccaaaaaacaagaagcattaatcgcacctattcaagataaaatctatgaagcggtaaaacagatttcagaacaaaaaggatatgcggcagtagtagacagaggctctgcccaaagtattattttcgcgtctccaagcattgatatcagcaatgaagtgctctcaagattaggatattcaaattaatttcctacatttgcaaccgataatccaaatttgcaataactaataaaaaatagaactatgttgaaaaaaattgctttactacttttactcatcgttccgatgagtgtatttgctcagaaattcgggcatcttaaatctgcagatgtacttactgtcatgccggaatttacaaaggctcagactgacatccaagctatgcagaaacaatatgaggatgaaatgaaacgtgcgactgatgaactgaccaaaaaatatactgaataccaacaggaacaagccaaccttcctaagaacattcaggaaagacgccagaaagaattgcaggaattacaggaaaaaggaatgcagttccaacaagacgcacaacagcaattgcagaaatcatacgctgatatgatggaacctatctacaaaaaaattgaggatgccatcaaagcagtaggccaggaaggtggatatacttatatctttgatttgaacagaacagaaattccctacgtaaatgaagcgcagtccacagatgtaactgctgctgtcaaagctaaagtaggaatcaaataattaagttaaagacctttacaggcacggattacacagatttcataggtttcgaaaccgtgaacatccgtgtaatccgtgcctgtattatatagctatactgccatgatcccatctctccccccttcaaccggccctatcggtgtattcgactccggctacggtggtctaaccattctggacaaaatacgcggactgatgcctgaatatgattatatctatttgggagacagcgcacgctgtccatacggaccgcgctcctttgaagttgtttacgaatttaccttgcaagccgtaagcaaactgttcgaactaggatgccctttggtgatattagcatgcaacacagcatcggcaaaagccttacgcaccatccagcagatcaatcttccggtaatagacgctacccgcagagtactcggggtcatccggcctacagcagaatgtataggagaaatcacccgaagccggcacgtaggcatactggccacagccggtaccatcaaatccgaatcctatcttttggaaatacataaattatctcccgacattgtggtaacaggagaagcctgtcccatgtgggtttccttagtagagaataatgaatatcaatcggaaggagccgactatttcgtcaaacaacatatcaaccggctgctggataaagacccgatgattgacaccatcatactgggatgtacccattatccgttactgcttgataaaataagacagtttactcccggacatatccgcatcatcgcacaaggagaatatgtagcccgaagtctgcaggactatttgaaccgccatcctgaaatggacgcacgttgcgaaaaaggaggaaaatgccgcttccttaccaccgaaagtgaaaacaagttcgaggaatccgcttccatcttcttaggtcggcaggacataaaagtagaaagcatagcattggaataactttcttccggtttacctgttatatataccatccataacgcttaattcatgaagatatgtatacaaataaagtaaagaagatagctgcggtacacgatttatccggtgcaggacgagtatctctcaccgtcgttatccctatcctctcatccatgggctttcaagtctgccctctgcccacagccgtattatccagccacacccaatacccgcacttctccttcttggacctcacggacgagatgcccaagattatcaacgaatggaagcaactgaagatacagtttgacgctatctatacaggctatctgggctctccccagcaaatacaaatcgtatcccggtttattgatgatttccgacaacctgacagtctggttatgatagatcctgttttgggagataacgggaaattatataccaacttcgatgaacaaatgattatggagatgcgccatctcatccggaaagccgatgttatcacacctaatatgaccgaactcttttatctgcttgacaaaccttataaagcagagaatacggacgcggaactgaaaaactatctgcacgaaatatcagaacacggtcccggtatcgtcattatcaccagcgtacccgtacaagatgactcgcacaagacttccgtatatgcatacgacaggcaaggagaccgttattggaaagttacttgcccctacctgcctgctcattaccccggcacaggtgatacatttaccagtgtgataactggctcactgatgcagggagacagcctgcctatcgccttggaccgcgccacacagttcatcctgcaaggcatccgcgccactttcggatatgaatatgataaccgagaaggaattctgctagagaaggtattgcacaatctggatatgccaatccagatcagcagttatgaactgatttgaggatcccgaaagtagaagatttgtcccccgggaaagaagcttgtaccaagccctattactccgacgattaaggtcgtttttccttatagctaacccttatcatacagttaactactacagactccggcagtggactgtacagtctactgcaagagtttatacagtccactatatcagactgtacaaaccaccggaagagactatagtacacaaccataaaaaagagcttaaccataaaacaaaatagggttaaccacaaagaagaaaagagtaaaaccaaagaaagcagccaaatcgtaccgtgcaaaccaacaaacatcagccgtatcaacaataataaataaattacctgcccagcagcctgcggctgagataacgcacgggataccacacagaaagaaagcccaccaccagcacagtgacaaaaactataacaatatcccatgcatggacactgaccggataggcatccaccacaaaattgccaccggagttaccacctcccagcgaaagcaatccgaattcctgctggataaaacaaaggatcaagcccagtaccactccgataaccgcacccatcaatgaaatcatacgcccctcgaacagaaagatacgcgtaatcaacttgtcgctggcccctaaattgcgcaatgtcactacatctgccttcttatctataatcagcatggacaatgagcctatcacattaaagcaggctatcatcaggataaaggtaaggaaaatataagagatcagcttctctatctccataatgcggaaagtatccgcttgctgctcataccggtcctgcacccggaaatcatctcccaatattttctgtatcttcgattttacactccctacatctacatccggcttcaatttcaattctaccgaactcacttctgtgtcatactgaaacaacctacgggcaaattggagggaagtcaaaatgtaagaagagtcatacttctgttggttcaccgcaaaaacaaggccgctggaatataaatcggcagagttaaagctggaagcaggattggccatattgactttaactccccgtttgggagcataaatctctagcggatcgaggaatttgatacccgttcccaagatagaaaccaattctatgccgggaatggcataatctaccacttcatcatgcaacacgaattgcccccggccgaaaaggatactgtcaatagcggtcagatcctcgaaattatcttcaattcctttaatcaccgccatggtctgacgatctttatactgaaccatcgcattctcttccaaagactcagaaaaaacagcgatctccggcatccggcgcaaagcttctatacgcgcttcttgtccgtcaaaaacctttccggtgacagccgtaattttcagctccgggtcaaaagccgtaaagaaagtagctaccagatcctggaagccgttaaaaacagacaaagtgcataccaatgtcaatgtagccaaagccactccgcagacggaaatggctgaaataacattaatggcattgtgcgacttcttggaaaaaagataacgcttcgctatataaaagggaaaattcaccgtccggttctactttttcaacagttcgtctatacgttcggcataatccaatgaatcatccacaaagaatttcaactcgggaatgatgcgcaactgatggcgtacccgtgttcctaattcataacggatggatttcatattatcattgatattctttactatttcctggctcctctcagaagggaacacgctgagatagacgcgtgcaatactcatatcgggactgatgcggacagcacttaccgacaccaaaacaccattcatggacttagtctgaagcaggaaaatctcactcaactccttttggatcaaacgagaaatcttattttgtctggtcgtttccataattaataattattcagtttgctaatttgctaatatgccatagggttcatagcgcaagctatgagcacattattcaacatttttttatgattgtcagcccgtcgcgcaagggaagaatcaccttttcaacccgtttgtcggcagctaccaaatcattaaatttctttattccaatagtctgaagatctgtatgatgcggttcctccaatacatgtccgtcccacaatgtgttgtcggcaatgatatatccgccgggtgataatttctccagtaccatttcgtaatattcaatatacttccgcttatcaccgtctacaaacgctaaatcaaaggtaatgttcatgccaggcagcaacttcagcgcatcacctatataaaatttaatcttgccggcgtaaggcgaaccttccagccagggacgtgtaaagtcctcctgctcatcgtttatctcaaatgtgtgcaacatggccccctcttccaacccttcggccaggcaaagtgcggagtagccactgtaagtcccgatttccaacacctgacgggggcgtatcatttgcacaaacattttcagcatacgtccctgcaagtggccggaagccatacggggacgtaaaagcttgacgtgcgtatcgcgataaagtgccttcaggtaatcactttcttcgtcaatgtgctgaaggatatattcgtcaatagcgtccgtttctttcattcctatcttctatttttataggtaacggttgcggttgggcagcacatagtccatagcatacttcaacacatctcccactacattgatttcaaggaaagaagtctgagtaccttgcttaccgctgctcagataggccaccatgtcgctttcactcaaaacgccatcatccagcaatttacgcaaagcagcgaaataatatgcctgtccgttagccttttcgggcatatagatagcctccaccccatatgacaaagccagatgacgcatcgttttttctttataacagatggccaatacaggatatttgccacggaaagcagcaatattacgtgcggtacgcccgctgaaactgtcggtaataatggcgcggatattcagtttgctggtagcctttactgcctgttttgccaggaaagcagttacgtcattggagttttcatccaaaggaatacggatgtcattctcggccagtttatctttctcagcctgcgctgcaatcttggccatcgtcttcacggcttccaccggatacttgccgtatgccgtttctccactcagcatcaatgcatccgtgcggtagtaaatagcattggcaatatcggtcacttcagcacgggtaggacgcggattattaatcatggtatgcaacatctgggtagcaacaatcaccggtttctttgccagaatacatttttttatcaacaaacgctgaatgccggggattcgttcctgaggaacttcaatgcccaagtcaccacgagccaccatgactccgtcggccacttccaatatttcatcaatattgtccactccttcctgattctcgatcttggcgataatcttaatgtcgctgccgtatgcatccagtatctggcggatatccagcacatcttgcttattacgaacaaacgaatgtgctatgaaatcaatgtccttttcaatagcatacagtatattgttacggtccttttctgtcaaagaagggagattgatgcgcacgcccggtacattcacactcttacggttacccaaagtagcttcattctgcacctcgcacaacaaatactcgtctgtcttctcaatcacgcgcagctccagatcaccatcatcaatcagaatatcgccatccacctgaagatcatgcacaaaaccgggataagatacagcaatacattcacgggtcgtttcttgtgctggattgcctacaatctttactttgtcaccaatctgataaggaataggctcgccgcctgcaatagcagtagtacgcacttcgggaccttttgtgtccatcaatatggcaatacggttggaaacctcacgtacattggttatcaatttttcaaaaccttcacgtgaagcgtgagccgtattcatacggaccacattcataccagccttgaaaagatctcttataaactctacctcgcaacgctgatctgagatggacgctacgatttttgtttgtttcaacatcataatcttatcaccttatattatacctaaactttttattttctcatcaacaaagcctcaatcgccaaacgatatgaatgaagcccgaacccacaaattactcccacacaagcgcaagaaatcatcgacttatggcgaaactcctcacgggtatgtacatttgagatgtgcacctcaatcacaggagctgtcacggagcggatagcatcctgtaaagcaatggaagtatgcgtataagcccctgcattcaagacgatgccgtcataatcaaaacccacttcgtgtattttattgatcatctcaccttccacattcgactgataatacgctatttcaatgtccggataagtacggcgcaattccaccagatagtcttcaaatgaaacagcaccataaatggaaggttcccgtttgcctaataaattgatattaggtccattaataatttgtattttcatatttatactatatctgaactttttctacctttgcagggaatttgggtacaaaggtagaaaaaagaaatgaaaagaaccgagaaaacagacaagatattggtgaaatacaagcaatatttaaagttggagaaatcgttatctgacaatacggtagatgcttatcttactgacctggacaagttactggcttatcttacattagaaaatatcaacattctggatgtccggcttgaaaatctggaagatttctcagccggattacatgatatcggcatccacccccgttcgcaggcacgcatcttgtcaggcatccgctctttctaccgtttcctcattatggaagattatctggaatccgacccaacagaattactggaatccccccagacaggtttcaaactgcccgaagtaatgacggtggaagaaatagacttattgataggcagcatagaccgcggaaccaaagaaggtcaacgcaacagagccatattggaaacactttacagttgcggactacgtgtttccgaactctgtaatctgaaattatccgaactttattttgaagaaggcttcatcaaggtggaagggaaaggaagcaaacagcggctggtccctatttcaccgcgtgccatcaaggaaatcaggctctacttcaccgaccgtaacctgatgaaaataaagccgggatttgaagattttgtcttcatcagcaatttcgggaagaacatctcccgcatcatggttttccatatcatcaaggaactggcagagcgcatcggtttgaaaaaaaaaatcagtcctcataccttccgccattcttttgcgacacacttgctggaaggaggcgccaacttgcgtgccatacagtgtatgcttggacacgaaagtatcgggaccacagaaatttatacacacatagaccgcaatatgttacgcagtgaaatcatagaacaccacccccgtaacatcaaattcagagaaaaaggtaaataaaggttctatattctaaaatattttaagataaattgaaaaaaaagcaggctaagaagctagcacataatagagtttttcctatctttgtccccaaagagacgcacaaaaacgtactatagcgaattttacattacaaacgttaaattaataaagtaactatgattaaaaagttgtatttgcccttagtggctttattggtccttgccctgtcatcatgcggcaagatgggagaattgtcttctgactatttcacaactaaccctgaagtgcttgaagcaatcggtggtaaagtgcctgtgacaattaatggtaaattccccgagaagtatttcaagaagaacgcaactgttgaagttacccctgttctgagatggaaaggtggcgaagctaaaggccagcctgctgtattccaaggagaaaaagtagaaggaaacaatcagactatcgcttacaaagcaggtggtagctatacgatgaaagcttctttcgactatgttcccgaaatggcaaactctgaactttatcttgatttcaagattacaaaaggaaagaaatcatacactattccttctgtgaaaatcgctgatggcgttatcgcgacttctgaactgcctactgctgccagctctaacgcatcatacgctaacgatgctttccaacgcatcattaaagatgctcaaactgctaacatcatgttcttgatccagcaagctaacttgcgcaacagtgaattgaattctgacgatatcaaagaattccataagaaagtggctgaagttaatgctgacaccaagaactacaaactgaataacattgaaatttctgcatacgcttcacctgatggtggtgtgaaactgaacaccggtttggctgaaaaccgtgaagcaaacacagaaaaatatatggaacgccagttgaagaaaggcaagattgatactaacctggatgcaaaatacactgcacaagattgggaaggtttccaagaactggtatccaaatcaaacttgcaggataaagatttgatcttgcgtgttctttctatgtacaatgatcctgaacaaagagaagctgaaatcaagaatatttcttctgtatacaaaactttggctgacgaaatcctgcctcagttacgtcgtgcccgtttaactgccaactatgacatcatcggtcgtagcgatgatgaaatcaacgaagcattcaactctgatcctaaagtattgagtgtagaagaattattgtacgctgctacactgactaacgacaacgcccgcaaagaagctatcttcaacaagacaactcaactttatccgaacgatttccgtgcttataacaacctgggtgaattggcattcgctgccggtgatgctgctaaagcagaaaactacttcaaacaagctgcttctaagaacgctagcgctcctgaagtaaacgctaaccttggtctttgcgaattggttaagggcaatgttgcagctgctgaaacttacttaggcaaagctacaggtgctaatgctgccggtgaagctttgggtaacttgtatatcaaacaaggccagtatgacagagctgtcaactcattcggtgacgctaagactaacagtgccgctcaagctcagattttggctaaagactataacaaagcaaaagcgaccttgtctgcaatcaagaatccggatgcaatgactgactacttgatggctatcgttggtgctcgcacaaacaatgcttcattggtaagcagcagcatcaagagcgcaatcgcaaaagatccttcaatggctgaaaaagctgctaacgatcgcgagttcgctaaatacgccgacgctatcaaataatataactagatatcatcttgtctagtttttagatgattattactgtaaccggaggcttcgtgatgaagcttccggcttttttatgtaaaataaccttcatttatacctgcctttagccacaaaatgcgtattttcgcaaaaaatatcttgaaatgaaaaaattactattctttcttttcactcttgttgtgctggcaagcggctgcggcaagaaaaatacattcaccttagaaggaagcattaaaggactcccttcagacactatattagtattttatcaagagcccgattacaagctagataccatactcctctcaaaaggcaaattcacttacactattacccctgacacatttactatcttttcattactattaggagaaaaacaaatcttgccgatatatgctgataaaggagaaagtgtcaccctaaacggaatggtcggagagatagaggttaaaggaaagggagaaaacgcacaactggcaaaacatatccagtaccttaacacattagaaaataacaaaactgccgttatggctgctgtggattcattaattaaaaccaatccacactcgtatagcaatatctatctgatagacaaatattatgtacaggactcgcttcctgactataaccacatagatcaactgataaaaggattaagcggtatcataaaagacacaccttatattatagatctccagaataaattaagtgagaaaaaagaactgacagatcatcgctacgtttccaacatctcgtgcacggacagagaaggaaagaccatcaactggaacagcgtaaaagggaaatatgtccttttggatttttgggcaagctggaacaaagaaagcattgccacacaagattctttagtacccgtacaaaaggcattgaaaaaaaataagtttgttattatcagcctctcccttgacttggacaaaaaggaatggatggagaaaatcattcaaagagacaccacacaatggaaacaagtttgcgatttcaaaggctgggacaattccattgtcaaacagcaaggcataacccggattcctgccaatatacttataggtcctgacaagcgggtcatcacgcaagatatacgcggcaaagaactgatagacaaagtgaaacagctgatagaacaagataaagagaaagaaaaagccgccaaagaggcagaacgtactcgaaagagacaaaataaaaaataaaagaatgctggtaaaagtctatggagcagccgttcaaggtatcgacgctaccattgtaactattgaagtaaatagttcacgaggtataaaattcttccttgtcggtctgccggactcggccgtgaaagaaagtcatgaacgtattatttccgctttacaggtaaacggatataaattccctacttgtcagattgtagtgaatatggcccctgctgacatacgtaaagaggggtctgcatacgatcttccgctagcaatcggaatattggccgctacccaaatcgtatcggaagaaaaactttcacgctatcttattatcggagaacttagcctagatggaagcctgcaacccgtcaaaggagctctctccatagctatcagtgcccgagaacaaggttttgaaggattcatacttcccaaacaaaatgcgcgagaagctgctgtagtaaacaatctgaaagtatatggcgtagaaaatatcaaagaggtcatcgaatttttcaataatgaacgcaatctggagcctagcatcgtcaatacacgggaagaattctatgaaaaccaaagtagctttccatacgattttgctgatgtaaaaggacaagaaagtgtaaaacgcgcattggaagtagccgcgtctggaggacacaacttgattatgatcggttcacccggaagtggaaagtccatgatggcaaagtgtatgccaagcattctccctcccctgtcattgggtgaaagtctggaaacgactaaaatacattcaatagcaggaaaattaggaaaagacagctcactgattgctattcggcctttccgtagtccccatcatacaatctcgcaagtagcaatggtaggtggcggcaccaatccccaaccgggagaaatcagtctggcccacaacggtttgctctttctagacgagttgccggaatttaatagaagtgtacttgaagtacttcgccaacccctagaggacaggtatatatccatctcacgagctaaatacagtctagattatccggccagtttcatgctggtagccagcatgaatccctgtccatgcggatattataatcatcccacacgagcttgcgtctgtaatcctggacaagtgcaacggtacctgaaccgtatctccggtcctttactggaccgcatagatatccaaatagaaatagttccggttccattcgagaaaatggcagaacaacatcatgcagaaagtagtgcaagcatacgcaaacgggttatcaaggcccggaaaatacaagctcaacgttttgctaaccatccgggtatttactgcaacgcacaaatggaagccggattactccatctgtatgctcaacccaatgaagcagggctaaaattattacaaactgccatgacacgcctcaacctgtcggcacgcgcatatggtcgtattctaaaagtagcacgtaccattgccgatctggacaacagcgaacacattacttccatccacctggcagaagcgataagctatagaaatcttgatagagaagactgggccggctagtttagctgccgggctcagtttcctttgcatgataaatgacctgcatcaatgaatccagttcaatgtaatttgcaagtatatcctcttcttcatcggtcatttcccaatctttattctcactctttttagagaaaagtacattcaaaatgaatttataccacgcattcatgattctttcaatctaaggttttcatcaaaaacagaataagaaaagtttagttcattaatcttccctatttttctcttttttcgatagctttatcgaacctttaggagagaactcaaattttcctacataccaatgtccaccctcttccaacttcttttgattcatatctttgattaaaacagaatctgatttaaatgcaccaccattttcttcgccgtctatatcattaaaatagactttctgttcattaattccacctatactcaagtcttcggtcttgaattctcctttttcatctgtataaattgtatcggcagggaaaacgccattattccaatcttgccttacgattacctgaatgtttttcaaaggctcatccttatccgaagtcactgtacctttcactaagaatttgctataaggagtaccatattcacatcgtatctcccaattctcatcttcattactgcaagaagcgaatccaagtaaaaccaacgctccggacaataaccgatgtactgtcattttctttttcatgttcataatccctaatagtttaaagtcagtttttatgttatttatcttctttagaaagttttatttccatgttgtattcataagtacctaaataccagtttccgtctcctttctttatttgtttactttccatatccttcatacagacagaatccgatttaaaagttcctccatttgcctcaccatctatatcattaaatatcaatttcttcgtatcgacccatccgtctctcatcatctgtgaaacaaactcacctccagaatctgtataaatagtatcattcatccggaccaactccccttcttcatcattataatatgcattctcattttttacaattacctgaatgtctttcaaagcctttccgtcatcagatatcaccttacctcttacccagaaatccatagtaggagttccatattccactgaggtttcagcacaagcagcaaaacccaataaagccagcacaccgcataagctctgctccaatactttcttctgtttcatcttcttcattcctttcttttttatggtgtttgcaatctttttaaatgacagaacaataaatctccattttcatcgcgcaggtgcatgccattccctttacagaaacgaaaatatttacaatcagcacattcatcttttttcatccattctcggtcacggtaaggtttgaatctatgattccatacttccataaaatcattctcataaatatttccctggtgataatcggcacgaatactgggacaagcagaaatcgctccatcaataagaactgagccgaccgatattcccgcccggcaagcgaagaaagtatcgcgcacttcagcctcataattacctagaaatccctcacaaccgtaacttacatggatccgtccttccttacggctcttcctaataaattccattactcctctgaactcctcattagacaattgaagttcaggatctttggctgcacgccctaccgggaatatagtaaaaagccgccaaccttttacccccaaacttatcaagaagtctttcaactcctccaaacgcatataactatgcttatttacacaagtaaccacatcaaaaacaaaatcaggaacctgtaccatcaacttgatcgcttcaacagcccgttcaaaactttgcgggttgccccgcatccagttatgatccgtcgcaaaaccgtcaagactgaccgtagccgtatgcaatccggcatccaacagcccattcaatcgttcacgagtcatatatagtccattagttaccattccccaaggaaaccctctttcataaatagcacgcccacactcttccagatccttcctcatcaagggttccccaccagtaataatcacaaagattttatgcggatcattttgagctgagacactatccaacacccgaagaaaatcttccttcggcatatcaggatgaccagcgatctttttacaatcactgccacaatgtcgacaatgcaaattacaacgaagagtacattcccaaaatagttgcttcaactgatgctcttccgtacgctcattttccaaccgccggaatatttcaagacccatccgacgacgaatagacaaaggggcatttatattcatgtgtttttccttttttatattaaatgcaaagaagtgcaaatcactgcatcacaatataacattttttgcaatttcccagcttccggcaaagcccccgaataacaatatcttataataagtatggtctgtcagaaattttaaaggagaaatatttctgattattccatatacttactaaaaatcactaactttgcacgttactggtagaaataacaaaaaaagacatcatacaatggaaaataaattcaaaagaaccaccgtcacatccgctttgccttacgcaaacggtccggtacatattggtcatctggcaggtgtatatgttcctgctgatatctacgtgcgctatctccgcctgaagaaagaagatgttcttttcatcggaggctctgacgaacacggagtacctatcaccattcgtgcaaagaaagaaggtattactccgcaagatgtggtggaccgctatcataccttgataaaagaatcattcaaagaatttggaatttcattcgatatatactctcgtactacatcaaaaacacaccacgaactagcttccgaattcttcaaaaccctgtatgataaaagtgagttcattgaaaagacctccatgcaatattatgacgaagaagcccatcagttcctggccgaccgttatattatcggtgaatgtcctcactgccatgcagaaggagcctacggtgaccaatgcgagaagtgcggaacatctctttctccaaccgacctgatcaatccgaaaagtgctatcagtggcagccaacctgtgatgcgtgaaactaaacactggtatctgccattggacaaacacgaaggatggctgcgtgaatggattcttgagaatcataaagaatggcgccctaatgtatacggacaatgtaaaagctggttggatatgggcttgcaacctcgtgcggtaagccgtgacttggattggggaatccctgttcctgtagaaggtgctgaaggaaaagtactttacgtatggtttgatgcccccatcggctatatttcaaatacaaaagaattacttcccgacagttgggaaacttggtggaaagatccagaaacccgtttgattcacttcatcggaaaagacaatattgtattccactgcattgttttccctgctatgctgaaagcagaaggaagctatatcttaccggataacgtacctagcaatgaattcctgaacctggaaggtgacaagatttccacttcacgcaactgggcagtatggttgcatgaatatttgcaggacttccccggcaaacaggatgtattgcgctatgtattgacagccaatgcccccgagacaaaagacaacgattttacctggaaagattttcaagcacgtaacaacaatgagttggtagctgtttatggtaactttgtaaaccgtgctttagtgctgactcataaatatttcgatgggaaagttccagtttgcggtgaattgaccgattacgataaagaaacattaaaagaatttgcagacgtaaaggcagaagtagaaaaactattggatgtattcaaattccgcgatgcacaaaaagaggcaatgaacctggcacgtatcggtaataaatacttagctgatacagaaccctggaaactggcaaagactgatatggaccgtgtagccaccattcttaacatagcattgcaactagttgccaatctggcaattgctttcgaacccttcctgcctttcagcagcgaaaagctccgccaaatgctgaatatggaaacatttgaatgggaccaactgggacgtaccgatctgctggcagaagggcatcaattgaataaagcagaactgttgttcgaaaagatcgaagatgaaaccattcaagcacaagtagacaaactgttggctaccaaaaaagcaaacgaggctgccagctataaagctaacccgataaaaccgataattgctttcgaagaatttgaaaagttagatatccgtgtaggtaccgtattagaatgtgaagtagtgcctaaaatgaaaaaactgctgaaattcaagattgctgacggactggagaaccgtaccatcgtcagcggtatcgcgcaacattataaaccggaagaactgataggcaaacaagttttattcattgccaaccttgctccgcgccaattcaagaatggactggtgagcgaaggcatgattctaagtgctgaaaactttgacggcaccttagcagtgacctcattattaagagaggtaaagccgggcagtgaagtgaaataatatacacccaaatacagaaaaggctgaaagcaactgaaacgtctgctttcagcctgactattttataatctatctataaaaatggcagaacaatccttgaaagaaaaaacagcaaaaggcctcttctggggtggactaagcaacggagtacagcagctgctgaatctttttttcgggatattcctatcacgcattctgaatgccgaagattatggcatggtgggaatgctatccatcttctctcttattgcaggttccttacaggaaagtgggttcacggcagccctagctaacaaacgggagatctcccacaaagactataatgccgtattctggttcagtaccggactaagtgcctgtctctacctcattttgttcctttgcgccccactcattgccgaattctatcatactcccgaactgacagctttggcacgatacactttcctcggtttctttgtagccagtttgggtattgcccacagtgcttacctgttccgcaacttaatggtcaagcaaaaggcaatggcggtcactatcggattaactgcctcaggaactatcggtataactatggcctgcttgggatttgcctattggggcatagccacacaaagcattgtttatgtaggaactattaatatctgttattggtgcttctcaccctggcgacctacacttactttcgatttcaagcctttaaaagggatgctttctttcagcagcaaattagtagtaaccaatatattcaaccacatcaataataatatctttaccgttattcttggtaaattctattcgggacaagaagtaggctattttactcaagctaataaatggaattatatgggacattcattaatttcaggaacagtcaacagtgtggcccaacctgtactttccagtttatcggatgaaagggaacgccaacaacgcgctttccggaagatgctccgcttcactgcctttatttctttcccggctatgttaggattatcattaatcgcacccgaactgattatgctgactattacggacaaatggttgcccagtgcctccatcctacagttgctctgcatcggtggcgcattcatccccataaccaatttgtattccaacctagttatcagcaaaggaaaatcggatatctacatgtggaataccatcagtttaggcattatccagttaacaaccatgctcctgctttatccatacggtgtacataccatgattatagtgtatgtatccatcaatatctgctggctgtttgtatggcactattttgtatggcaacaaatacggctcaacttgttcgcagcactgaaagacatccttccgtttgccttcatagctactgcggtaatggcagctacctattatgtcactatcggctttgccaatctgtatttattaatggcaagcaagattatcatagccggcacactctacacagccatcctgtggttgagcggctctgtcacttttaaagagagtttacactatataatcaagaaataatggctgctacacgtcactccggattagaatgtttacgaattatcagtatcatactgattgtatccatgcatattctagggaataccttccacaccagtaatttgctgaacaaagaattcatactatttgtcaatacattgggaaacacaggagtaactttattcattctgatctcaggctatttcggaatccgtttcaatacacataaatttttcaagatgctggttgtcgtatggttttattccatcgtttcttatctgatcgaaacaatatggcttcacactccgcatacctggacaggactagcctcctcattgataccgatacttagcaaaaaatactggtttatgacctgctatgtagtgctttattgtttctcaccctatttaaaccgactggttcaaaacctctcacaaaaaagttatgaacaactactgttactatggggattcttttttatatttgccccgacaatcctgttttttgaaattcaaaatgacacaggtaagggaattatcaatgtcacactagcttatctcataggacaatatctgaaggtctatggtcttccgaaaaacatgaaacgacatagctgggatattttatcagggagccttgccggtatttttatactgaattccctgcttacagcaatgagtggaaatatcatactgagattcgcccgagataataatctactgattatcatcgcctctatcatggttttctaccagttcacccgatggcatttttcatcccgcatcatcaattacctagcaggatacgtttttgccttatatatgcttcaaggacttcttatccactgtttacaaccctggtataccccttatgcaaacagcaatctacttgttctgtattttatgggaacacttgtttctatctgtctgacaacacttgttatagaatggagcagacggctgctattaggaaaaatagaaaacaaattagcagatgcaatggaaagaagaggagcaaaaattaaaatgtttacagataatcattaaaacaattatttatttccgcaactcataatttcaaaatctccaatggagtccctcctatctgagctgccatatccgaaaatgaactctgaaaagaaccatatattttttgtgtacgggccaatgtgtacatatccgtgataccctcccttattccctccaaagatccacggtctgccttttttccggaacagaatatccggtcaccataacgctctttcatctcccgcttcacctcttccgaatctgtagccaaatagatagccaccttatcgtcctcttttatctcctcatccagtttctgatagaataactcgatagggctttgccggatagaagccagattatctgtacgacggatatgcataccaatcatggtatccgaaaaattccgacaacggttttccacctcttccataacctcttctaccggaacaaataaccgactgatccatacataatcataaggttgaaaagcggtatatgatgccatataaacacagctaccttctttaacccaccgttcaaaatcaaaatgccgattacataaaggagtaatagaacgctcgtacaggcaagacttgaaaaacagtttctgaaacaaaagcgggaaatgaaaattcctggaacgaggtctgtccaacaatgcataatccaactgcgaagcatcccgcaaacaggcaatcttcctgtccacaggtttgaacaattggctaaacggtgcatttagcgcccaatcctgaaaccaaacgatacttaaatcactatcactcttcgctgccagtgtcacggccgaagccaccgcacgcatacggttagccagtcctcctaccggtacaaatgtaattttacccattctcattaaattttaaggcaaatataaacaacatcgcttataaatgctaattaattactacttttgcatagtcccccgataaacaaaagaaatgagaaaaaatatcgcaatcgtattagcaggaggtataggcagccgcttaggtctgtccactcccaagcaattttttaaagtagcgggcaaaatggtagtcgagcatacaatagatgctttcgaaagcaatccgcacatcgatgaaattgccattgtttccaatcctttttatattgctgactttgagtccatcattatcaagaatggatggaaaaaagtgaagaagattctgaaaggcggtcaggaaagatttcattccagcctttcggctatcaaagcttacgaaggcagcgatgtcaacctgattttccatgatgctgtacgtccattggtcagccaacgtattctaaatgatgtcatcaaagcattggaaacatatgcagctattgatgtcgccatgcctgccactgacaccattatcgaagtagatggagatttcattcatcagattcccgaccggtccaaactaaaacgggggcagactccacaagcttttcatttggaaaccatcagccacgcttatgaaatcgccttgaaagacgaacatttcaaagttaccgatgactgtggggttgttgtaaaatatttacccgatgtacctgtatatgtagttacaggcgaggaaagcaacatgaagctgacctataaagaagatacctacctattggacaaattcttccagttacgtaaaagtgagctgaatgaaattccattgaatgaaagccaactgaaagacaaagtagccgtcatcttcggtggaagctatggaataggagaacatacagcccgtatgctacaggagaaacaagcaaaagtattctgtttttcccgaagcatgaacggtgtggatgtaggcaaaaaggaacaagtggccgatgctctaaaaaaagtattcttacaaacccacagaatagactatatcatcaacacggctggcgtcctcaacaaagagcctttgatgagttcggactatcaaacgatatacaatgcggtgagcaccaactatatgggaactatcaacgtagcgatggaggcgtacgcctatttaaaagaaagcaaagggaaattagttttcttcacctccagttcctatactcgcggcagagctttctacagcatctattcctctacgaaagcggccattgtaaactttgtacaagctatcgcacaagaatgggaaccgtttggcattgctgttaattgcatcaaccccgaacgtaccaaaactcccatgcgcgtaaaaaacttcggaacagaacctgagaacaccctattatcagcagaaaaggtcgcaattgccaccatacagtcattggtttccgaatttacaggacaagtaattgatgtaaaaagaaataaagtatgaaaaatgaatttctatctacctatgtagccaataacctgcgagcctgccaactgaagcaactctccatattagaagaaatggaccgtatttgccaaaagcaccacctgacctactggctggacggaggtacattattgggagccgtgcgccacggaggattcatcccttgggatgatgatatagatataggaatgccattggccgatatgcaaaaattcatagaagtagctcctgacgaactatccgaagggttattcctccaaaccccacaaagtgatccttcaagcaaggaaccgattataaaagtgagggacttgaactctctgtatgtagaattcggcgataattttaatgcggattatcaaaaggggctttttgtagatatattcccatttattgattaccccagcatacccaaatcatgggtaaagaagctaaccaaaggaatctccaaaagctattccattctgcatacgcaacattattattctctacgtgccttcgcagaattcttttacttcggcacaaaatactggctgttcaaaggaatatggaatctgcttggtctgctctacaaaaaagatacttatctttccaatgttctgataaacaatggatacggtatcatgcaccgcaaagactctgtatttcccatatcagaaataatttttgaagggaaaccattcaaggcacctgccaacccagatgcttacctgaaagatttatataagaattacatggacattcctcccaaagacaaacagaaaatccatgccatttatattcaccccgaattgataaagaaaccatgaaaccgttccttgtagatgtacccgtactcattttgttcttcaaccgcccgcaacaactatcacaagtgtttgaacaagtcaggaatgcccgtccctccaagcttttcctctatcaggacggaccacgtggcgaacacgacctgcccggtataaaagcatgtcgtgaagtgacagatcagatagactgggattgcaaagtccatcgcatgtatcaggagaagaactatggttgcgacccatcggaatacatctcacaaaaatgggctttttctatggttgacaaatgtatcgtattggaagatgacgatgtgccttccgtttcttttttcacattctgtaaagaaatgttagacaaatacgagcaagacacccgtatcaccatgattgcaggtttcaataacgaagagattactccggatgtaccatacgattatttctttgcctccaccttctcgatttggggatgggccagttggaaaagggtcatcgaccaatgggacgagcattatacttttctagaggataagttcaatatgcaacaactggagcagctcattaaagaacggaaattccgcaaagactttatctacatgtgccatcgccataaagaaaacaacaaagcctattatgaaaccatcttccacgcttccatgcttttcaactcgggactggctatcgtacctacccgcaacatgattaacaatttgggagtcacagcagattccacccattttgccggttctgttcatacactgcccaaaggataccgccgcatcttcaccatgaaacggtatgaagtagaatttcctctcaagcatccccgttatgtcattgagaatgtagcttataaaaaagccgtctaccgcatcatggggtggggacatccctggattaagataggacgttctttcgaagaattatttctgaacctgcgatacggcaatttttccatcattactaaagcaataaaaaacagaattaacaaatggctgaaaagagaccaacaccggtaaaaccactcactatttatttttatcacacccggttaacccgtgaaagttacgaggaatggaaagattataagtttccgggacacattctctacggacttcctttgctggaaaaatatggcatccggtcggtaatgcataaatacaaagctttccccggccgtctaagactgatgctctatgccactaaagagattctgtgctgcaaagagccatacgaagtactctacggtacatctttccgtggactggagctaattatcctgctcagagcattaggattctaccgcaaacccatcgtcatttggcatcacactgccttaaaaacttcatccggaaaaataagagaacatatctcacgtttcttttataaaggcattgaccatatgttcctattcagtaaaaaattgattaaagactcattagcgaccgggaaagctcccgaagaaaagcttcagcttatccattggggaccggatctcgctttctatgaccatattctacaagtaatgccagatcggaaaccagaaggctttatctccaccgggaaagaaaaccgggatgtaaacactatgctgcaagctttctgcgccaccgaacaacaactggacttgtacatcgcccccaccaatggaagtgtaaactaccaacagattattgaaagcttttgtctacccgattctgtacaagtacactatacggacggtgtcatcccatacttattggcacagaaagtggcacgaaaaagctgtgttgtcatctgctgtatggattttccttataccgtaggccttaccacattggtagaagcctttgcattaggcatccctgtcatttgctcacgtaatcccaattttgaaatggatatagacaaagaagaaataggaattaccgtagcctataatgacgtggaaggctggatcaacgccattcatcgcatagccgaccatcccgaagaagcccaaaagatgggcgccaacgcccgaaagttggcagaaaaacgtttcaatttggaaatcttttcccatgaaatagcagaaagcttactggaaatatctaagatgtcctctaaaaaacgtacatttgcataaacttttatgcacatgagagtacttatcatcaatacgtctgagcgaataggtggagccgccattgcagccaaccgcctcatggaggctttaaaaaacaacggaataaaggcaaaaatgcttgtacgtgacaagcagaccgaccagataagtgtcgttgaactaaagaaatcatggtggaaagtatggcaattcatctgggaacgtgtcgttatctggcaagccaaccacttcaagaaacataacttgtttgccgttgacatagccaataccggcaccaatatcacagtattgcccgaatttacccaggccgacgtcattcatctgcactggattaaccaaggtatgttgtcactgacagatatccggcgtatcatccaatccggcaaacccatcgtttggacaatgcatgatatgtggccttttaccggtatctgccattatgcaggagattgcgataaatatgccacacaatgccacaactgtccgcaactttacaaaggaagcagaaaagacatagcctaccgtactttccagaaaaagaaaaaactgtttgaaggagcacaaatcacctttgtagcttgtagccgctggttagaatcattggctaagaaaagtgatctgattaaaggtcagaccattaccaatattcccaatgcaatcaacaccaacctgttcaaacctcgtgataaaaaacaggccagagaaaaatgccatcttccgcaagacaagaagttattgcttttcggctccgtaaaaattacagacaagagaaaaggaatagactatctggtatcagcttgcaaacaaattgcttcctcatatcctgattttagtaaagaattaggtgtagtggtttttggtaaccaagccgaacaatacacttccctgtttcccttccctatctatccgatgaattatgtcagcaacgagaaggaactggtagatatctacaatgcagtcgacttatacgtcacaccttctttacaagacaatctacccaataccatcgtagaagcaatggcctgtggtattccgtgtatagggttcaatgtaggaggtattccacaaatgattgaccacctgcacaacggttatgttgccgaatatcagtcttccaaggatctggcaaacggcattcactgggcattgaccgaaggagaatatgaaagtctgagtgaggaagcctgccgtaaggcagtatccagttattcggaaagtaccattgccaagaaatatgttgaaatctataacaagattacagggaatcatgcataaccatcatcctcatcccaagttttctattattaccgtcacctacaatgcagcaaaagtgttggaggatactatacaaagtattgttacacaaacttataagaatctggagtatattattgtggacgggggatcaacagatgaaacactggatatcattcacaaataccaggaacatatcaccactgttatcagtgagcccgaccaaggtttatacgatgccatgaacaaaggaataaaattggcaaccggagattatctttgtttcttgaatgccggtgatggcctgcacgaggatgatactttgctgcaaatggtacattccatcaatggaacagccctgccgggagtgctatatggagaaacagaaatagtggacagtcaagggcattttttatacatgcgccacctgtctgcacccgcaacgcttacctggaaaagcttcaagcaaggaatgttggtttgccatcaagcctttttcgcccgccgtgatctggtagagccatacgacctgcaatatcggttctcggcagattttgactggtgtatccgtatcatgaagaaagcggatgtactccataatacccatcttactcttattgattacctgaatgaaggaatgaccacccgtaaccataaagcctccttgaaagaacgcttccgtattatgagccgtcactatggatgggcaagcacagtgacacaccacttatggttcgttctgcgcctgctctacaaataatccggaagtctgactaataacgggactcaatcaattttcctacgggcctttctgacctgcaagaacaagaacaagaccaacacacaggccaatacacccaatgccacaaaagccaccgtttccgtaacatgcagcgatttcgggtcgaacttaaattccactacatgctttccggccggcacattcattgcccgaagaatataatccgctcttccgtgcggcgcttccacaccatcaatatatgcctgccaaccgggatagtaaatttccgagaaaaccactgttcctccagttttggaattaacctcatatttcaagtcattaggttcgtacgcagtcagtttgattgtactcagtgtatctgtttcagctgccgattttacctccgcactgaattttttatctacgacagccgtttttgccgggtctatccgatgcaaagcgtctatctcttcattggcattgtccacatactgcacctcgtttacaaaccaagcattgcccagcgtatgaggattccgtattgggacggtctttccaccttgcagcggaaaaataaagtaacgggtattcagcatattcaacacaggaaatccggacggagccaccttctgcatatcacctcccgcctccgaaacagccttgaacacgccattcatctcggtactgatatgctcctctatcatttcctgatagcggcgcagtttggcggcatgatatccaccgatgctcttatgccaataagaagtcgtattttcattaaacgtattgccggctaggttcagcacccggaaatccaacgttttatcggccaatattgccttatccgtttcggtcggtttaaaggaattatcctgttgtaccttttccacaaactggtcatcatacaaataacgtttgttcacactccacatatctgccagacagaggacagccaatgccagaatcgtcaccttcgctttcagcttgcccatgccatataaccaaagaactgccgtacctatcataataataaagaagctgcgccatgcatccgaagtaaagacactccgacggatttcttctagattagcaagtaacggagccagctgatctgccggaataccctgcaatgcctgcatttccatgcttgaaacatacgacgggaaaaagaaaccgggagccaatgcaaacaataaagcgataccacctgtcaatcccagactgatataaaacgaccgggcccgttccttaaccaactgaggacgtgccattacctcctttaaagcaaggacagccaacagaggtatggtaaactcagcaatgaccaaaatggaagaaaccgcacggaatttatcgtacatcgggatataatccaaaaagaaatcagtgaatcccataaaattctttccccatgacagcaggacagacaaaacagtagcactcaaaagcgcccatttcataggacctttcactataaacagtccaagaataaacagaaacattacaaacgcccccacgtatacaggaccggatgtaccgggttgctcgccccaatactggcctatctggctatagatgctattatacataggattcgccttttccatcgccttttcgttagctgctaaaggtacggaagcgccacctttcacattaggaacaagcaaagagaaagtctcaccgataccgtaactccactgagtgatataatctcgttccagaccacttttagtctgattatgactatccggtttcaccagctcactctttccacgcatcgtttccttactatactcatacgtatgatataagttggatagatttatgcaaactcccaaaataccggccatcaacaacaccccagttgctttcagaaattgcggcatttccttcttctgccaagcatccactccaaacgcaaccgccataaagagcatgacaaatagaaaataataactcatctgcacatggttcgacactatctgcaaagcaacaaaaaccgctgtcagcaaaccgcctgacaagtattttcctctataagccaataccataccggctatagtgggtggaatataggccaaggttacaaatttccagatgtgtccggcagctataatgatgaaaaaataagaagaaaacgcccacaacacagcccccaatgaagccagccagaccgagaaatcgaatgcacgcaataatatataaaagcccaacagcatgacaaatacataccacacataattcgggagatacaaatgatacaacttctccactcccttcagggtatccgtagaatcataactgggtgccatctgataagtaggcataccaccaaaaatcgaattagtccagcgcgtacgctctcccgtacgttccagatattctttcgcttcttcaccagcaccaatgcccgccacagagtcatgttgtgaaaggatacgcccttctgtcactgccgggaaaaaatagacgaatgagatgacagcaaagaggataatcactactatatcaggtagtattcttttaaataagttcataagtatatctgtttattaacgttgcaaagatacgatatactctgataaaatgcgtacatttgcagccataaataaagttgaattatgaaaataggaattataacagccatgagttccgagcagaaacaagtaacgcaactgctcgaaaacaagaaagaatacaccgaaggtcctttccaatatactgaaggcagcattagaaataataccattatcctgatgaaatgcggaataggtaaagtgaacgctgctgccggtactgtagaactgatccgtaccttccagcccgactgtgtcatcagcaccggtgtagcaggaggtatagacagctgcctgaaaataatggatgttgtggtgagccgacaaattgtatatcatgatgtatggtgtggagaaggcaatgtgtatggacagatacaaggacttcccgcccgattcgaaggtaatgctacattgtttgattgcgccatgtcactggatactccgaccgccattcatggaggcctgatatgcagtggagacaaatttatcaccgaccgttccgaacttaacgacattaaagaaaagttccacgaagggctggcagtagatatggaatcgggagccatcgcccaaatctgttatatatataaggtaccgttcatcagtttccgtatcatcagcgatacaccgggagccgacaaccattgggaacaatacacaaatttttgggagactatagccgaccgttccttcgaggtcactcataccttcctttcctcattaccagctaatttataaaaacgaataatatgaaaacaatacccagttttaccattgatcatatccgcttgcttcgcggtatctatgtatccagaaaagacgaaatgggcagtgaaacggtcaccacctttgacatccgcatgaaagaacctaaccgggaacctgctttgggacaaggagccttgcatactatagagcatctagctgccacctacctacgtaaccaccctatatggtctgacaaaattgtctactggggaccgatgggatgcctcactggcaactacctgttgatgaaaggcgatttaaaatcagaagatattgtagaactgatgcaggaaacgttccgctttatagccaattttgaaggcgaagttccgggagccgcccctaaagattgcggtaactacttgcttcatgacctgcctatggccaaatgggagtcggccaaatatctgcatgaagtattggaacacatgacaaaagataatctgtattatcctactaaagagtaattctctacaacagaacagtagaaacgtaataacagaaaatagaaaagccgctctctgaaaagaaagcggcttttctttaagtccttttcaataaagattgaattacttacgtaatcctaatgctttaacaatagcacgatatctttcgatatcacgattcttcaggtagttcaacaacgcacggcgtttacctaccaaagttgtcaaagctctttcagtgctataatcttttctgttgagcttcaggtgctcagtcaggtgagaaatacggtatgaaaacaaagctatctgcgcttcagctgagccagtatcagtgttagactttccgtacttttcaaagatttcttgttttttagctgcatctaaatacataattcttagattttttgatatataaaattttcatttagcgggtgcaaagatagacattatcttttatatcacaatgaattagagcgatttattttttaaataatcttctatctcttttactgtcgcatctttcagcaacacctttttgtccttatccaacagataaagagcaggcatcgctttcaaatcatagcattcttcggtcagtaccgtcaattctttatcatagctgttgatccatccatcaggaatttcattctggtgtttcgtccatacttcacggtcttcatcgggatagaaagcaagaattttcacttgtttcatgatgtggggactgttcaatacagcagaggtcttcattgtcgccagtgtttcggcacaaccatgacaatccggattatagaataacaataaagtgtaaggagtgcagatatcacgcatacgtttctgcattcccgaaggcaaggtataaataaaatcagcggcaatactgcccaccttgttcataccaatcaatttcaaatcatgttgggcacggctccgagcagcctcatcggtcagcgaagaagcagacaggaaacggcagacaggctcataaagctcctcattccgaaggggagaattcggatcaaacaagtatctgcggaaaatttccacaaaataaccaaacatttttttctcctgcgaagcctgctgcataatccggattaaacaactgtccgacagggaagatggcacacggttcaataagtccatgtaatctaccaaagcttgttctgtgatatccggtacatgaatataagcggtatccttaaaattaaaatgatcccagtaatgctgtaccataaagttcagccggtcttccggggattgcaacataatagggacctccggcaaagtgaaagtcaacgatttattatcatcattcacagatagagatttttgttttttgccatcacaagcgataagcaaaaaacagcacaagactccgatccatatatcagtttttctcatacgcttttaattaggcattgcaccttttacaaaagtagaaggaattctctgaaaagccaaattacttcgaaattactttactcagccagccactcatgaaatccattgtgaggggtataatgtaatacatattccgttttgctgtagctgataatattttcgtgcgaaatccggcttacatccacttctgcttttgccagccacaaagtatcctccatgacataacaccctaaggacactctcagcatcatctggctcaggtagaaagcagactgttcataagcataccactttccatcctgttcccaatagatatatatcaagtcggaattgctcagctccctttctaatatggtcactacctctcacataggagttggcggtaatcgtttttaatcaatatcatctcagtgtctgaacacagggcaacaaaccacggaccgttcagcagtttgttcaggtctacttctaccttgtctaacataacaccgtagaaaaaacatgcctctttcagtttcaaggccgcctcactaagtttgcttaaggatttggcggaacgatggtaagcataccagcgcccttcctcttcatacagataaacttccgatttactacatgattctttgtccattatttccagtaggttgttcatactatttaacatcttttacacaacgaacttttagatcagcatcagtagcatggacagttacattggttccttggaaccaaaaaccataagaagacctataagcaccatttgctttacttcctgaatagtccgtgcggcaggtaacataaccactcaacagattgtttgcgctcatcagacccagttctttctgattaggcattcgccaaattcctttatcagtttttccgctatcctcataatagtatttacaaggatcatattccggtcttttcttattcttaatcgtataataattattattccatccaccatccaccatcttttgttttagatagtctttagacacttgtatccgtgaagacaatccattgatttcatcacgctccaaatggatatctatagtttctgtagtccctttggttgcagtcaaacctgtcaatgtaaatatattgtcactatactgatagaatttattcgcttcgtacagtccgtcgtctgatgccaacgtacgcacacagcgaaccaaattcgcatgttgccaaccggtattaacctctttattacttgtggacaacccttcttcagcccaaaaaatgctattggtaccggtagaagccgtgaaatagtgatatttagcattctctttgtcattatcattgagcgtgctcattttagccctaaacaagcgggcgtccgggtcaacgctattcaatgcaccctcgccataccacaatccgcgatactgatcaacagaggccatataccattttacctcattagcttcaatcgtgccgtttccattcaaatcccggttacggctcatacatgcccgtatcgcctgttggtacatgggttgcctcccgtctgccggtacaatcatattagtgtccggataccatgatttttccttgttgctttgtacggcactgttacgggcattccaagcattaggattcttgtgctcacccaaattattcttattcaaataataagcagtagacaattcttcctcggttatattctccgttccataaggataaccattgaaaccgaaatgatagaacgtagtaatggaacgctgagaaagactgtaacgcacttttgcataaagactcttcctgtccgtgctcaccgacaactgattggcaataagtatggtacgaggcgcacaattggaatagacagtccatgatttccctttataatagttttcgtccacgaaacaggtgtaataagcgtatccatcatttgagaatacttcatcttgattgctatccgcattttcgtataatgccttcaacataaagaacacattaacccaagatgcgccatatttatttgcatactcattattgtcacccggatatttggcaacggtggttaaactctgtcctgaaattctgtttttagaaacattgcgtacaaaacgcagccatccataatcatcctctccattaaaaaggctctgcccgcttatcggacggattgttcctccatcaaacgtagccaattgtacatcaccttcggcattaaagattcccccatcggtaacatacaaattctccgtataaccgaaaggtgttgagattcttactatatatccttttcccgcctctttcagcgtctttatattttcccgagagaatgtcagcactctggcctcataatgagcgtccaaatcaaaagactctcctccttcactgtcaatcaccaatccttccacataggggttgtctccctcgacttccgcttccactttgatatcctcgacaccgtttactttcaccttatatttataagagtaattccggcgtatattgaagtcttcaagacttccggtattactgaagttgccaaaatggatagtatacgaaacctccccgatagtggtgcctttcttataatttccacgaatcacgatataggaagaattatccggtgcattatcgaacgatttcacgtcatccgtataggtattcgtttcacgatccttccacatctttatctcacctccccgataggaacggatattctcgggaagataaaaagttaacgtttccccggccataccagaataagatgactcgacatctgcggtagtagcgtcagctgtaccattcaccaactttccaccgacagccacattatgcaattcatacgtactgggagtgaaagttactccgttaccggcctcaatggtaaatgtattcttcgccaatattctgtacagtcttataacgttgctttcgcttataacaccggctccattggttccggcagtaattgtaacagccttgcccccattcagataaccggacatcatgaactgtccgtcggtaggattaggggaaataatgtggctggcattaccatactggcgtttaaagtctattgcaaggaactcgtctcttgtcaatgaggaacctgccacatccgcttcatcaattcccgtcaatttatttttgtctgcgtcatccaagtaataaattgtactgttcaagttggcaagagcatagatatacgcttcaccggttattgcctttacagtaacggtttccggtccgggagtcggtataggactcgactctgtagccaccagctttttatatcctgtcagttctcctgccgcattaaacacataaaagtgtaaatcattcaacctgttttcagcagtactggcgcgcgaaacaatcacttcctgattggtctgcaactgacaattcaactgcaaaatcacctctttattctcttcaccggcagagtaagctatttcctcttccgagcaagcccccacgcctatcagtaacgaaaggcaaagcgccatatatttcagtttatttttcatatatagtatcctccacagattattttcttacatcaccgccaccgtcaccaaaatccaattcgccattaccaacctctgtccaatccattacttgatattgaagttctgcatctatctcgatcgtactcagtttaatattgaacaggtatgaatggttacggattacatcaaatatatctccatctccattcgtccggaatttaatagttcccactttggttttgttatgataggtataatgaaccgtcaatgaaatttcattcccacctgtagtattcaccttttccggcagataaatttcattttcatatgctgtcgtcacctgcaagccgtcataagtaatagtctgattctgtgctccagcaggaatagaaggatatatatattgaaccgtttccaccggatttggagtttccgttgaaacacaatagcctttgtcgttggcattgttcactattatctttgtgatagtgaatccttgatatccatcctgcatattcacccaaatgcccacctttgctacagcacgataaaggttgcaagccaagtccactcccgtaccgggtacagctgtcaaattgctgcttccccacatcgggatagctctttctgcaagtttccaaggtatcgtagatccaccataatgataaaccaattctttataaactttggcgatattacttcctttctttgtttccagaaaattacgtatagccgctccggtcgtataagacgctatcttattgtctttcaagttagccagaacaaccagtttcacttgttcgccaccgaccgttctcaacatggttccttccagctgacgagtataatagttgtcaccttcaacaggattgcctagtttcaaatcctgtacttgatacaaaaagttatcatttgcatcaacgaccaatacatatacatcatccgcagtcatggcactttgttccactgtggtataatctaaatcacctggttcgcttgcggcccgtccgccgaaattggagaatgccagtgtaaggcgtaccggtaccttcccgccatccgtagcctttgccacctcctcgtcctttgcacacgacgataggtacaagccgcagagcaccgccattagtatatatgataaccatcttttcatagattctattttttgttcgttgttacatatccatctcgttgaagcgtaccacccagtcattgataatgatgctggtgttaatccacttcatgttctcgtccaggaagaaagtcatgttgtattcgtcctgacgatccagatattcctgctgggtcatgtcgtgaccttcggcctcggtgagcaataggtattttaccaaggggatggagagtacggtctcgcccgtatccttgttggtgatggacaggcgcggattttgatccaccatcagtcggcctacggtaatctgggcaatggccacgctgatattgctatcctcagtatcgccctcggcacgtgcgccttttgtgtccatgtccgtgcttccttgaacgcggtaatagggataatatgttaatgtttcgtctttcaacagcttgttgtcatagttcatcaggccgttgtcgtccgtaatcgtgaattcaaagttatcgacatctacagtcactccgtccatttgctggagaatgatgcggatgctgttggtattcttcaccaacggcactgtcaccacctgcgaggtggcagccctggaaaaggattgcttggtcacttcgccgtgccacaacgaagaaagcttgctgttaacgatagccgttccgtcttccgcacggctgtacattctgtccatcttgcattgcagctcgtccatcgaggattcccccgcggtaaccaaaggtaccgagaatgaagcttcgttattcaagcccgcccaagtgataagatgatagtcacctggttccaaatctactttcatggtatatccgtcttcacccaaaacgtcaccttcttccatcttctgatacaccaatttgccgttatcgtcaaaagcataaagcgtaacagtccccacctcgcgtgagaaagcatcggcatacttcatgttataatcatatttgaacttcactctgtactctacagagcaatccacatcttcttcatcgagtatgctgccgcacgacacaatggcacttcccaatgtcatcgccatcattaggctgaaagagagttgttgggcgaatgtttttactgttttcatgcttttgtttttttaatgttagaatattaaagagaatagcagggagaggaggaacactcctctcctgcttatataatagggttattaattagaaattaacagtgttaaagcgtacaatccaaggagctattgtagttgtcagtttcaagtatgcactttcatcgtctattgttccaccatcttccggtataattgtcgagctgccgatttccttgaaagttccaatcttcaatgaatagatgttgttacgcatgatagcatattgcatattgttttcgtttcctttgaaatgttcgataggtgcgtagtaataacaatatccatctgtataagttaccaaattctcagccttataagccgggtaaacagatttcaaagcatccattgaacggaaatactgattggcatatttatatatggtacctacattagtaccctcattatccaagatttcgccacggaatacaatacctgttaccacgcctttttgctggtgatcctttgttactgaattttcaaggcaataagtcaggaatgcatcgttagattgtgcaatttcaccaatttcaacatcacttgacttaggaaggtccttcaagaaagcattgttataaatatcctgtgaagtctgtaattcacctactgtattgaagaaataatctgtagctgttttatctccatcagcccacaatccgtctgttagtgtcacgctattcttgtccactgacttaggatctaccaaataatcactattagtcaatgtaccaaatggagagatggtactccaatcactggtcttatgtcttaccgcataaacggtttttgacaagttcaccatagcatatttatccaaatacacagtccatgtctcctctgctgttgtagaagttcctttttcataatggaaagcacccgttctatctgttgctacaaatacaggagcttctattgaagtcgttgtttcattctgtttaacattacctttatatttattatcaagagttgactccaactgatatctgcccgtttcgtttccaccatttagcaaaacccaaatttctgcattatcagcgtcaagtaaagccttgttcaatttagtgatataaatgtagctggttttatcagctgttgttgttttcaaccatccgtcagtggttaccgtagggatagtggttactttaacctttacattatatttattgtcattattgttcggtgtaaatgttatcttggaaaccacacgctccactcttatggcttgaatgataggttgtgtagggtcctgacttgtgatatttaccattgccgcttcactattagccatcataaaatgatctcttgccgatgcacctttcgtaacaacatcaacagatgcgtcgttagagcttcctgcggtaatagaataatttgtaacatactcatatacaccagcagctgttgcacttgtttcttttgccttatttgctatatctgcacaaggattcaaaataaccaatacattataactacctgtttggttcaattggaagctaggttcgtaaacgccactcgttacagttatattatcagcatactccactaatcctgtcgctgtatttccctgaaccgggctaatgataatgacagcatctttaatactaccttccgagggtgttccattttccacatcatctcctgtttcagcatcggcagcacgtcctgaacctgtagaagtagagatacttaatgtaaggttagctttcaccttttctggttgttcaatattgttgttttctacaatatcatcgtttgtacatgctaccaaagcggcgcaagcaaacattcctaataataaacccttaatcttcataatcttaagtttttcagtttataaattctttatttttgtaatttctattcttgttcattgatattgcaaaggtaaaggccttttaaggttagtcttaattggtgttttcggcaaaatagattggcatctttgacaaaatgacttttggagtctttttgaagggcattttcttcatccatgaatgaaacgccctatactttgcaagaatcgccacttatatttttcgtagcgataaacaaaaaatacgccgccatatatgtttgtatttttcaatttgttaaattgttcaatattcatccttttgtctaactgaacttcctgttacgcttcccccttttgatactccttctgaagttggtgaagtgcatttcattcaaactccttatttatctggtactttctttccgtaccggatagtcatggaatatagcggattcagagattgcggacaagtgggagaaaatactaagaaattcagcttcacggctactacactacgccagattcaatccgcacctacagtagaggttcttcaaagagattggttcaaatccagcaatgaggtgtttccttaaggagtcgttcacaattatttcacctaatattccggtctgaattccactcataatgcagttccaaaaagtaagtgcagttcatgaagcaagtaagtggccttactttttttctataatatgggtaactgtccggatgaaaaaataataaagatatttgcgagtatctacttatcaggtttaataaatagctatagccataaaattcaaaatccgggaatagactctactaccccggattttaccttgcgcttttcacaaagaacaagtttcttctaacatcttttattgtactgtttgtctatatgtcttattttccaaagattgcatcatctttacgtttattgaccatttcttccaaattggcaccggcttcaacagaacctttggcctgcgcctgtttgaaataactttcggcagagtcgagatccccttgcaacagtttcagcacgcctctgttgttcagcgtcgcactcgcttgtgcatcagccttatccaaataacggactgactgttgcaagtcacctcgttggagttcgatagcggcagcgtttatattcgctgttgggtcatcagggaacatgcgcactgccacatcgaacacttcgttaaactcgttgcttcccttttcgtatgtctgagcaaccaagaacatttcctgcaagctcaactgctggggacgggttcttataatctgtttcgcttcctctacattgaatccgcgtactacataacgcactgtgtaatcagagtgacgcaaagccggatagcaatcttgtaataacgtggcatatacttttccaccatccaaggctttaatgcatccctccttcacatcataatcgttttcattcttatctattatagacaaaatttcatctttcagcggtaaagcattctttgtgacatattcacgcaatccagcccagtcttcgggcacagaattcactttgaacagatctgctttaaaaccatactcgctcattacatagttctttaacgcttcagcacgaccttgcgccagacgcgcattagccgcatatctgccctcaggagaggcataacccacgatatctatttcagtaatggtagtattggcatcattcttcaccacatccactgtacgcttgatagctgccagttcagagggattacgacgataatcaggataaatcctggtctggtttaccggaaaatccaaataagcacggccttcttcagcacgattcttcacagcctcgacagcaggagaaacaaatgccacagcaggtttcaccacataacgctccaaattggcacgggtcacaaaggcgctgctttcttctttttggcaattggcacaaccacggacatcagccaacagttccagttcagcaccattcatccatttctcgtatggaatacgggctgaataatttacagtctgttccgttccattcttacgacgaagaatggtatatgcatccgacggaatactgcgttcacgctgttgcacgatggaacggatacgcccatatacccaaatagcaggcaaaatcctgttataactgttatcctgtgtcttcaaaaccggagtcagagttgccacacagttggaagaaagctccattgcagtcggcaacgtgatatccattcctatcatcacctgtccattatcactaatcaggattgactggttgctgacttgtacctgaccacctgataatgtctgtgcacctaccggaatagtcggaatcaataatataagaagtatataacatataagtttcataatccgtaatttttagaatatataaataagattcagagcagccttagtaggaccccaataattcttgttggatttctccaacatatctccacattcttcacactcatatttcttataacgcacataagcataacccaagccgatggtggcgcccagattccaatgacgtcccagcacaaactgataaccgtaactgacaccgccaccataaaaatgtcccttataacggaagtctttcaaatcatcgaaaggagaaaacggcaaatcaataccggtagtattgtatgctcctcccattaaatggaaaccgaagaaatgaccattgaacttatcacaaagccaatagcgcaactcaggctgtaccatcaccagtttcagcattttattatcgctgtatttccagggattataataaaacggaatatccactgtaagcttcttactcaaccctacttccactcctaagtttggtatggcgacagcatccatcgccacattagttttaacagccatctgtccatacataaataaggaagaagccaacagacacacccatgaaaataaaaatcttcgtattaccatattctattctttctagctaagttattgtttacttcacaaaggtaaaggctatttttttaacaggatattggcaaattaatctttattaagaggtagtttcagcaaaatgcaaaatgaacaaaaaacaatcctagttcctattttcgtcaaaaatagaacatacattcaatgagaaacattccaactatcaaatggaacaccaacggagttttctccattcataggtgaaactcctttcatcatgatagaaacgccccttatatagccaaacacccccttctttccaacatagcaggcattttcatcaaaaagagggtgttttcatcaaaaaagcttgaaaataatttggatacataaaaggaatacctatttttgtatcggatgataatgggtcaatcattcaaataatcaaaaaacaataaaaaattatagttctatgaaggcaatgcatttaataattgccatgctcgtcatgatgagtttggcatcctgctctgcagatggtaatgaccccgttgaaaactctgtttcaacgtatctcctagaaaaaacgtatggagccagaagcgttacatacaaagaaaataattctgacaagttaaaattaagtgaattaccggctatcagtctttctgaggccgaccatattctatctgtcctacgaaaacatactgatgctcaagaagaacttgatattcgaactgctaccaaaggagaacaaacatggctgagaattgtaatgaagcaaacaatagatcataaatatgctttcactatccagctgaatatgaactgttacagtgacggaagcttgtactatggcggatatcaggcggaatgttcttcttctttgataaaatggtatcttaaaggttttagcctggctaccgataatgccacaaaaaattataaattcgaatcccaaagctatatttatatgaaagtaatagataacggaatcaaatatatgcagattcctgtcactataaaaggcaactataatccccgaaaccatgatgctgcattttcctacaatttatgatatataatgcaataatcactttataatatataccatcattccccccttgtttctagcttagcctacataccttaaaaaaagcaagagacaaggggtgcacttcattcaaatacaatcgtctaataatcaaggaaaaacaaaacagtatgaatgaaatacctaccatcctttatttccaccgaacctgttgatactaaaaacagaatatattcttatgatttttagttggttatgaaaatatagtttgctatatttgtaggaattcctaaaatagattaaggaataatatcaggcagattgtacgtgaccaatttgattacaggggaataaaagtgaaacaatttattataatgaaatctttaataatcaccttattatgtagtttttgtctatcaactactaatgcccaaagttatttccgccagtgtggtatccaactacttaccaaacaaaacggattgagcaacaatacattgactggaatctatcaggataaagccggctttttatggttaggaaccgatgttggactgagccgctatgacggaatacattttcataattacaatttgattgataaagagccacgtgccttagctcatttatatgaaacatcaaacaatctgctatggtcccatatcgccaatttaaaccaaatagcatgttttgacaagatgcgtggaatctatatgccacttatctcacctacccctgaggtattgaaagatatacaggatatatgtgtactgcaagacaaattatatgccttgacctccaatgtcatagtagagttaaagatggagaaaaatgcagatgaaataagactgaccgcccaaccgcttatagatataaaaacaaaagtcctaaaactttataataacgaagatattttatgcgcactgacagtagagaatcaaatcttactttataacgtttccgataaaagtagcgagcatataaatggaaccgatctaggtattgtgaaagccgacaacattgaaaaaatacatatatataataataatgtgtggatctgtgaccaaaccgaaggaatcatctgttataatacaaacactaaaacatcccgcacactgaatgacaacagccagtcatccttcattcaaaaagatatacgcgatattatccagatagataaaaccacattcattatagccacatggagttcactgtcagccataagatttgaaacggacaactacctccagtcgccattccacattatagacctgacccaacatgattcttactatacccctatcctcaaaaacagaattaccgacatccattttgacaaatccaacaatgtgctttgggtaggaactttcggcagaggattactgaaactgaatctcaaaggaaacgatatcaaccgtatcctgttgaacgatgaaataagatatgtgaatggtatagcacaagatgccgatggatacatctggctggtcaccgaaaaagatggcatatataaaagtatagaaaataagatcttccccaatctgcgcttttccttatgggagaaaagtaacaagaataatcattattgcctgcacaaagatcgaaatggaggactatggttcggcgataacaaagaaaacattctttgggtaaatcctactaccggtgaaacagtgattcaccaactaccccccgaaacagcagactctgctgtaactgctgctatcttgaaactatatctaaactcacaaaaccatttatggattgccaccgaaaaaggaataatggtctataaccatcagacacacgaatgtatagcagcacaaccttatacgaaagaattcaaaaaaataaccgctatatgcgaagatggagatggaaccatgtggctgggtactgaaaaagggatacaccgtgccaactgtaaagggaaacaaataaaattcactggtggttatgaaaaggaaagaaacctgacacccggaaaagtattagcactttatctgaacaactataaccaactgcttatctcgtacactgataaaattatccaaatagacggaaaagagaaaaccgtatcctctaccatgatcttgcaaaaggacttgcctaacggacacataagctgtatgatagatgataagaacggaaatacctggctaggaagcaatgctggttttatcacactaaataacaagaacaatgcatcatatgcctatgcattaccggagagttattacgatgtatgtcggctgaatgacgggaaattactatgggcgaactctacagggttgctctattttgaaccgcgcactttaaaagaaagttcaagtaaccgccaattccatatctccgatatagatattaattacaataaagtagaaataggagaaaaaataaacggacaagtcatcctagacatacctgcgtacctgatagaacatttatctttagactacaataacaacaacttgattctctatctaagtgatttgaaatacggaacctcgcccaacacagtgaaatatcgcctgttacccacagaagaaaaatggaatacgaattatgacgatcatataaaactcagcaatatcactcctgggaaatatgtgctggaaatacgctcgtcttatccgttggaagaaaatgaacaaataacccggttatccatcaatgtaaatagatattgggctgcaaccggatgggccatcgccgcatacatcctgactattatcattatttccttgtttacatggatgtactttaaccggaaattacagaaacggcaagtttacaaagccaaagaagtgaaactgaaagaaaagctggaagaagaaacagaaataagaaaagaagaagagaaaaaccaccaattgcgtgaccaaatcagatatatgttggcacaggaattacgcactccgttatcactcatcactgctccgttaaaagaaatgattactaatacgaccttcccggaatcattcctgcaaaaagctaaaatggcctatcggaattcaatcagcctgcaagacatttgtaaccagctattgaatattcatcagcaagaaagttacagtcttaaattgaatgtggccccctatcccgccagcgtgatagccgacactgtagttcgtgcctctcacgagctactgaacgtcagtcccattaacctgcattatgacaaagacaacaaaataaatacagaaatatggattgaccggaaaaagataacctttattctaagtaatatattatccaatgcatatcggcatatctcgtattccggttccatccgttttactgtaaacaccagtattatcaacggaaaggatttctgcctttttactatagaggatgacgggaaagaaatgatagaagagtcctctgttatcttccttggatcggataattacaaccctccaagcaaccggctacaccccgaattaggcattgaaattatgaaaacgacagtactcgcccaccacggtgatatccagatcactcaagaaaaaaacaaaggaacccgagttgtcctttatatccctctaggtaagcaacatttgaaaaatgatgaaaacgtatgtttcatcgaacccgaaacaatagcggaagatccaaataaagcaatgattaccgcagaggataagagacaacaggaaatagcaaacagcataactgccaaacctattgacaaccccgaaaccaaatacaaactactggttgttgaagaccatgcagatatccgcctctatctgaaagtattattctctgctacctataatattattatggcggaaaatggggaagaaggagtaagaatagcgcgtaaagaaataccggatcttgtaataacggatgtcatgatgcctatcatgaacggttttgaatgttgccgtatcctaaaagaagatctaaaaacttgccatatccctattattctactgacagctttgacagatgacgaaaatatagtgaaaggaatagaattaggagctgatgactatattctgaagccgttcaatccggagattctccgcaccaaagtaaaacgtttaataaaaagccggactgaactgaaacagatttataccaaactactaatgccttccatcaccgtcaacggctcgcaagaagaaaatacggaaacaatcatcatagaagacccgttcatcacacaaattctgaatattgtaaatgagaacctgcaaaatccggaattcaatgtgaaaaaactggccgaaatgctgaatatgagtcaacctaccctttacaggaaagtaaaacaactcactaatttcactatcatagaattagtaagaggagtccggttaaaacgctctgccgaattactgagaagccgcaaatacaatgttcaggaggtggccgaaatggttggttataatgacatccccactttcagaaagcactttgtcgatttctatggcactactccctccacatttaatagtaaagaagatacggaagataaaaaataatcgttaacagccaaatattttttgaattaaaaatcgtacctttgcagccaaatatataggtatagtatgcaagacattagaaacattgcgatcatcgcccacgtagaccacggaaaaacaacactggtggacaagatgatgctggcgggacatttgttccgcaacgaccagacaaatggtgaactggtattggataataatgacttggaacgcgaaagagggataactatcctttcaaagaacgtttcaattaactacaaaggaacaaaaatcaatattattgatactccgggacacgccgacttcggtggcgaagtagaacgtgtactcaatatggctgatggatgtatcttattggtagatgcattcgaaggcccgatgccgcagacacgcttcgtattgcaaaaggcgttacagatcggtttgaaacctgtagttgttgtgaacaaggtggataaacccaactgccgtccggaagaagtatacgaaatggtattcgacttgatgttcagcctgaatgctacagaagatcagttggacttccccgttatttatggttctgccaaaaataattggatgagtactgactggaagaccccaacagaaaatctggttccgttgttggatgctattattgagcacattccagcaccgaaacagctagagggaactcctcaaatgttaatcacctctttagactattcagcatatacaggtcgtatagctgtgggacgtgtacatcgtggtaccctgaaagaaggtatgaatattacactggcaaagcgtgatggcagtctgataaagtctaaaatcaaagaactacatacttttgaaggcttaggacgtaaaaagacagatgccgtttcatcgggagatatctgtgctgtagtaggtgtagaaggcttcgaaattggtgataccatctgcgatttcgaaaatccggaaccattgccccccatcgccattgacgaaccgaccatgagcatgttattcactatcaacgattctcctttcttcggcaaagaaggtaagtttgtgacttcacgccacatccaagatcgcttgaccaaagaactagataagaacctggcattgcgtgtacgcaaaagcgaactggaagacggtaaatggattgtatcaggacgtggtgtacttcatctttctgtactgattgaaaccatgcgccgcgaaggatacgaattacaagtaggacagcctcaggttattttcaaagaaatagacggagtaaaatgcgaacctatcgaagaattaacgatcagtgtgcccgaagaatattccagtaaaatgatcgatatggtaacccgccgtaagggtgatttggtttctatggaaacacagggtgaccgcgtaaacattgagtttgatatgccttcgcgcggtattatcggtcttcgcaccaatgtactgactgcatcggccggagaagcgatcatggcccaccgctttaaatgttaccaaccatacaaaggtgagatagaacgtcgcagcaacggttctatgattgctatggaaagcggaacagcttttgcatacgctattgacaaattacaggatcgtggcaaatttttcatttatccgcaagacgaagtatatgccggccaagtggtaggtgaacatgttcatgaaaacgacttggtgatcaatgtaactaaatcgaaaaagcttaccaatatgcgcgcatcaggttctgatgacaaggcacgcatcattcctccggtagtattctcgttggaagaagcattagaatacattaaggaagatgaatatgtagaagttactccaaagagtatgcgtatgcgtaaagtgattcttgacgaaacagaacgcaagagagccaacaaaagctaatcaatctacattgaatataaaaaaatcccgaaggccatattaccttcgggattttttatctctaatctacaaacttcactttactaacctctctaggtttagcagccggcatttcatcgggataaccgaaagcaatcgcataaagcaactcatacccttcactgaatcccaactttttcatatattccgcagctgcaggtgatttcatgaaacgcacaggtcctcccaaacaacaggaacctattcccattgaccaggcagacaaaatcatattctcacccaacaaaccacaatcgatctgtgacatatcatatgcaggatcgttagcaataaacactactgtaggagcattattgaacatattcttaaatcccggacgttctgccgctttgggattttcttttttgaatatttcagtcaaaccattgataaattccggattatctactacacgaacctcccatgactgtttattcattccattaggtgcattgattccacattctactatagtctgcatcttttcacgctccacagcctcgggcttatacttccgtatactacggcgactcataatagtttctaccacagggtttacctggctcacggaaacactatccgcaacaacttccttctgtcgggagccttgcgatgtacagctgcataatacgaacatgcctgcaccaactaacattaatctaaataatttcatttgctatcatatttggtttgcaacaaatctaggcattttcaagcataaaaaaaagtggttcctttataaggaaccactttttatatgttaaatctgtaaaattcaaattacaacttcggaccagcagcaaccaatttcttacctgcttcgttaccagtaaacttagcaaagttcttaatgaagcgaccagccaaatctttagctttttcatcccactgagcagcgtcagcataagtatcacgaggatcaaggatcttcggatcaacacccggcaattctgtaggaacaacgaaatcgaagtaaggaataaccttagtaggagccttatcaatagaaccatccagaatagcatcaatgataccacgagtatcacggatagagatacgtttaccagtaccgttccaaccagtgttaaccaagtatgctttagcaccagtcttttccatcttcttaaccaattcttcagcatacttagtaggatgcaatgacaagaaagcagcaccgaagcaagcagagaatgtcggagtcggttcagtgataccacgttctgtaccagccaatttagctgtaaatccagacaagaagtaatactgagcctgttcaggattcaagatagataccggaggcaatacaccgaatgcatcagctgacaagaaaataacttgttgagcgtgaggacctttagagataggtttaacaatgttttcgatatgatagataggataagaaacacgagtattttctgttacgctcttatcagcgaaatcaatcttaccgttagcatcaactgttacgttttcaagcaaagcgtcacgtttgatagcagcgtagatatcgggttcgctttccttatccaagttgataactttagcatagcaaccaccttcgtagttgaatacaccttcgtcatcccatccgtgttcatcgtcaccgatcaacttacgtttcggatcagtagacaaagtagtcttacctgtaccagacaaaccgaagaaaatagctgagctagttccttccatatttgtattagcagagcagtgcatagaagcgataccacgaagcgggttcatgtagttcatgatagagaacatacctttcttcatttcaccaccgtaccaagtattcaggataacttgttctttagtcttcaagttgaaaacagtagctgtttcagagttcaagcccagttctttatagttgtcaacttttgctttagaagcgttgaaacatacaaaatcaggttctccataagcttccagttcttcagcagtaggacggatgaacatgttagttacgaagtgagcctgccaagctacttccataatgaaacgtactttcatacgagttgcagcgttagcaccgcagaaagtatcaacaacgaacaaacgcttgccgctcaattgttttacagctttagctttcaaatcagcccaagcttcttctgtacaaggtttgttatcatttttatattcgtcagaagtccaccatactgaattttcagaagcttcattcttaacgaagaatttatctttaggagaacgacctgtgtaaacaccagtcattacgtttacagcacccagttcagtaacctgtcctttttcgaaaccttccaatcccggtttagtttcttcagcgaaaagcacatcataagaaggattgtggagaacttccttcacgtcggtaataccgtacttgcttaaatctaaatttgccattttttaatgatttaatttggttattgtataatgttatttttactctttattttctgagagaagatgtttttcaacacccccttgtctaaggcgctacaaaattagtgctttattttaaaaaaaagaagttattagagaaaaatttccgtaataatcaaatatttatatttgtgtaacaaaaatgcaattcgtactttacaaatctagaaattatttgtttctttgcaggtcaaagtcaacaatataacaaaagcatagatatgaaaatcatcaatctcagtgaaggcaattctctcctaaaccaatatgtagcggaattgcgcgatatacatgttcaaaatgaccgtatgcgtttccgcagaaatattgaaagaataggagaaatcatggcatacgagatgagtaaagcactaacctattccgtaaagcaagtacagacacccttgggaactgccacggccagcacacacgatgacaaaatagtgattgcaacggtattccgtgccggactgccgttgcacaccggttttctgaacatgttcgaccatgccgacaacgctttcgtttccgcattccgtttttacaaggatgacgagcaccatattgtagatgtgcacattgaatacatcgccgccccttcattgaatgacaggaccttgcttctcgttgaccccatgcttgccaccggtgaaagcatggaacttgcctggaaagctttccttaccaaaggcaaacccgctaaattgcaaatggcctgtgtcattgccagccaacaaggggtaaagcatatggcagaactttttcccggcgatgatgtcacattatggtgtgccgccatagaccctgtcttggacgagcacaaatacattgttccgggattgggggatgccggtgatttagcattcggcgagaaactttagggctcaaactataaagacagtttcacgtgtgttcgcttgcacacactaaaattctaaattaaatggttagtaaccggcaattattcacagcctattactaaccatttaatttttaaaacagttctgtagatctggtccctacagggaagatgaaaaatcttatttcacttcccaaatatcatttgtcatcagtaattcctggaaattgtgatattttttctttgcggccacttcttcaatctgtgcattaacagcgtcatcataagtaggcgcctccacatcacggatcacccctaatgcaaccggaaaatccggtccttccatcaatgccagtttcaactgcaaagtattatccatacaatgagcatcgtgcactaaaatatctttttccgtcacaccattctcaccaagctttaccactttcagtccgaaaccttcctgcatcagcccgtattctttgtctacaccaaacaacatcggtttaccgtgttctaaataaatggcattctttgaacgaccttctttcgtatatactgattcgtgtgttccatcattaaaaatgacgcagttctgaagaatttcacatacagccgcacctttatgattggcagcagctttcagaatctccactgtaccaggaccatccgtagctaccgcacgggcaaagaaacgtccacgcgcaccaaaacataattcagccggatgaaacggatcttccacagtgccgtaaggagatgatttgctaacaaatccacggggagaagtcggagaatactgtcctttggtcaaaccatatatacggttgttcaacaaaatcatattcaagtcgatattacgacgaacggcatgtataaagtgatttccaccaatagccagcccatcaccatcccctgaaatctgccaaacagtaatctttggattagccaccttgcagcctgtagaaatagctgccgcacgaccgtgcacagtctgcatggcatatgtattcatgtaataaggcaggcggctggaacatccgatacccgaaataacggcagtatcatgaggagccactcccaattcagccatcgctttgtgcagcgaagccaagaaaaaatggtcaccacaacccggacaccaacgaggttgtccctttttgaaatcttttgctgtatattcgttcatagtctttactttctttacggttattatttatttaaaatctcagtgaaagcatcaactaactcgctgactacgaacggctggccttttacctcattaaactgataaggaacaaatccgtccactttcatacggagatatccggcaaactgaccaagattctgctcagccacgactaccttcttatatttcttcagcacttctgccgtattttgaggcagcgggttcaaatgaacaaaatgtgccaaagcaaccttcttgcctgcatggttcatttcctccattgctgaatacaaatgaccgtaagttccaccgaaacccactatcaacaaatctgcatcctctacgcagccttgcaccttaacattaggcactggaattttagcaatcttctcggcacgcaaacggcacatcaaattatggttttcaggctcggtagaaatagcacctgtatcactgtctttttccaagcctcccaaaatatgcatataaccttcctgtcccggcaatgcccaataacggacacctgtttcagtattacgcttgtaaggagtataattatccttcatttccggagtaacatagggtgggttaatagccggatagtttgccagatcaggcaatttccatgcgccggaaccatttgctacaaaaccatcagtcagcaacaccaccggagtcatgtgttccaaggcaatcttacaagcatcataagcagcatcaaaacaatgagttggagaagctgcggcaatgaccggcataggagattcaccgttacggccaaacaaagcctgcaataaatctgtttgctcagacttagtaggcaaaccagtagaaggaccgccacgctgtacattaataaccaccaatggtaattctgtaataacagccagattcatagcctctgatttcagacaaacacccggccccgaagtagaagtagccgccaacgcacctgcaaacgaggcaccgatagccgtagcgcaacctgaaatttcatcttcacattgaacagtagtcactcccaatgatttatgtttagaaagctcatgtaaaatatctgttgccggagtaatgggataagatcccaagaacaaacgcaggcctgctttctcggcagcagcgatcaagccataagccgtagccttgtttccgctgatatccatatactttccggggactttagacttagtttccaccttataagtatgatccacagacgcatgggtattgtggccataatcatatccggcgtgtatcactttaatattcgcttcagctatttgcggcttctttgcaaatttctcgcgcaaaaaattttcagcaaccgccaggtcacgattaaacaaccagcaaaccaatcccaaagcaaacatattacgacatttcaacattgacttgttgtccatgcctgtatctgccagacagtctttcaccatctgtgaaataggagcagcaattacatcctgcttaatacccatttcttcaatcggattgtctgttttgaaagccgccttgtccagatctgatttctgaaaacaatctgtatcaataatgatacaagctgtggacttcgcaaatttgtattgtgttttcaatgcagcggcattcattgcgaccaatacgtcgcatttgtcaccaggagtaaaaactttacccgcaccaatatgcacctggaaacctgacacaccggtcaacgaaccttgcggggcacgtatatccgccgggtaatcggggaatgtactgatatcatttcccactgtagccgaaatattagaaaagatatttccggccagctgcataccatcgcctgagtcgcctgagaaacggaccaccacttggtccaactccttgactatcatttcatctgccataacttattatttagggttacaaaatttcactgtttgcaaagttcggaaagttctgtcaaaggacaaaatattccgctgtcaaactacgtttgaatatcaaaatgtacaaaattaaaggtttatttatttccaagctaagaaaaagtagagataattacctgtttaaaagcataaatttctatcattatgacagcagcaaaaacgattcatttttacaatttattatttttatccatgttttataaacaacatgaaagttcatagcagaataataacattattagattataaaaaacagacaaaaaacaacaaaacaacaaagaaaggattattttcttcccacttaagacatttttcgatctttcatattgccattttaacaaaaaggagtacctttgtagccataaaagggccttgtagttcaacggatagaatagaagtttcctaaactttagataggggttcgattcccctcggggctacaaaagcagtaaacaattactatacaatcatttactgcttttattttatctagaaattctttagattacttatttaatcaccccaagttctttacccactttaataaatgcagcaattgccttatccaaatgtgccttttcatgaccggcagacaattggacgcggatacgtgcctgccctttcggaacaaccggataatagaaaccagttacatatatgccttcttcctgcatcttggcagcaaaatcctgagacagtttcgcatcataaagcatcacagcacaaatcgcgctctgagttggtttgatgtcaaaaccagcagccagcatcctgtcacggaaataattcacattatccatcaacttagtatgcaaggcatcactttccttcaacatcttaaacatttccaagctagcaccgataatggcaggagctacagaattagagaataaataaggacgtgaacgctggcgcaacatatcaataatttctttcttaccggtggtaaatcctcccattgccccaccaaatgctttccctaatgtaccagtaaaaatatccacacgaccgtatgctttaaattgttcggccacgccatgccctgtaggacctactacaccggccgaatgagattcatccaccattaccaacgcgtcatatttttccgccagttcacaaatcttatccaatggagccacattaccatccatcgagaatacaccatctgtagcaataatgcggtgacgctgtgcctgcgcttcctgcaaacaacgttccaagtcagccatatcagcattagcgtaacgatagcgttttgccttacacaaacgtacaccatctataatagatgcatgattcaacgcatctgaaataatagcgtcttcttctgtaaacagcggttcgaacaaaccaccgttagcatcaaaacaagcagcataaagtatagtatcttctgttttaaaataatcagaaatggcagcttccagctgtttgtgtaaatcctgagtcccacagataaagcgtacggaagacataccgaagccatgtgtatccattgcctctttggcagcattgatcaaacgttggttatctgacaaacctaaataattgttggcacaaaagttcaacacatcttctccgtcattcaccttgatgtctgcacgctgaggtgtggtaatgatacgttcatttttatacaatccggctgccttaatatcagccagttccttcgcaaggaactccttcattttaccatacatagctttgtttttttattaagtatatagtttaagtttaaaaatcagtctgacttgacaaagttcttatttttttttgatatccaattaaattatagagaaaattttgataaaatatgcagttttctatctatctttgcttccaaaaggaaacttaaagcaaatagcaaactatgaaaaatgtattaattatcggctccaccggtcagatcggttcggaactaaccatgaaattgagaagtatttacaatggtaatatcgtagccggatatattcccggtgccgagcctaaaggggaattaaaagaatcaggcccttctgccatcgtagatatcaccaatgaacaacaaattgccgaaactgtatcaaagtacaacatcgacaccatttacaatctggcagccttactctcggctgtagcagaagccaaacctcaactagcatggaaaataggcatgggaggcctgtttaatgtattggaagtagcacgcgaaatgggttgtgccgtatttaccccaagttctatcggtgtcttcggtaacaacacccctaaagacaagactccacaagacactatccgtaatccgcgtaccatgtatggcgttacaaaagtatcaggagaattactgagcgattattaccatatccgttttggtgtagatacccgttccgttcgtttccccggattaatttcgtatgtcacacctccgggtggcgggaccactgattatgctgtagacatctattattcggctgtaaaaggtgaaaaatttgaatgtcctatcgcagccgatacattcatggatatgatgtatatgcctgatggtttacgtgcagccattgaaatcatggaagcgaatcccgacaaactaattcatcgcaattcgttcaacattgcttcaatgagttttgatccggaaattatttataataatataaagaagtatatgcctgacttccatatggagtacaaagtagatccactacgtcaagctatcgccgaatcatggccgaactcactggacgacacttgtgcccgtgaggaatggggatggaaaccggaatatgatctagacagtatgacacaggatatgcttgccaaactaaaagtacgattcaataaataaaccactaatattgaatgtataaaaatagccttctctatcttttccatatagaatagagaaggctatttttatacatttcttgcacttatataaaattttgatcgtatcttcgtgcaaattaacatactgattaaaaacatactatgaatacaagagctattaccaaaaacaagaaagtcgttacattcggagaagtaatgttaaggctgaccacccccaatttccagcgcttttcccaaacaaacgagtttattgctacttatggaggaagtgaagcgaatgtagccatatcactggtcaacttcggcatctccacagaattcgttaccagacttcccgagaatgcaatggcacaagcttgtgtaaactcactccaagcttacggattaggtacagacggcattatttatggcgggaaacgcatgggattatactttctggagagcggtgcagcatttcgtaactccaatgtagtatatgaccgtgaaggatcttcctttgccactttacgtcccggcatgatagactgggaaaagattctttccgatgcaggctggttccactggtcgggtatagcggcgtccctgtcacaggaaggagcagatacctgcctggaagcactacaaacagcagaccgtctagggttaactatctcgtgcgatttgaatttccgcaaaaaattatggaattacggtaaatccgcttcagaagtaatgctccctcttgtccaatatagtgatgtcatttttggtgcagaacccgaatacaaagaaattttcggcattcccccggtaggttttaaagctgtagacacctcatatccattagatttgtccggtttcaaagtattcggtcaaaaagtatcagaacaagcgccccgatgccagaaaatatttctggaattgcgtaataccatcacttccaatcacaatctgctggcagccatactttattctaaaggaacattaaggcataccggtatttacgatattgtccatgaggtagaccgtgtaggtgcaggagatgcatttgtaggcggcatgatttatggtttgctgacctactccgacaatgaccaaaaaacattagaattcgcccttgccgcatctgcattaaaaaataccatatatggagatttcaatcaagtaacagtagaagaagtggaaggattaatgcaaggaaacacttcaggaagagtagtcagataactattttcatgattatagccaaacagaattgatctgcaaaatgtagcgtaaaaaagcaagtttacttcatggggcaagcaagctaagttacttatccaatgtacttaagtttatttttgaagccacagaagattcatctatcctttttccacaaatcaattccattcagtcattataaaaagaggaggattctcatgatatgagcatcctcctctttttatttatttcttaaaagaaactttctttttatgcctttgtttcttccggcatcttgttgcccatagtcaggtaagcgataggagcagcaatgaagatagaagacaacgtaccgatcacaacgcccaaaatcattgcaaaagcgaagctgcggatactgtcaccacccagcacaaagatacacaacaatacgattaatgtacttaatgaagtattgatggtacgagccaaagtagtattcagtgaatcgttaaacaactgcatacggttacgtttcggatacagaccgaagaactcacggatacggtcaaagataaccaccttgtcattgatagaataaccgatagcggtcaaaacggcaccaatgaaggtctggtcaatttccaatgagaacggaacccatccataacataatgagtatgcaccgataatcagaatagtatcgacagccaatgcaacagtcgcacccacactataagctacattgcggaaacgcagcaagatatacaaaccgatagccaccagtgcaaacaatacagaccaaatagccgatgtcttgatatcatcagcgatactgggacctactttctgagaactgataatagaaccaccgacacgattatcacgatcaataaagatttccaatgtagtaccttcgcccagcaagttaccatctttcaaagactgatacaagaactcttcaatttcggagtcgatagtaggagactcttcattaatacggtagttggttgtaatacggattgtcttcttatccgtacccaaggcgatagcctgtacattatcttctgtgattttcttcttcaacaagtcacgcactgtttcaggttcaacctgctgttcaaactgaactacgaagttacgtccaccggtaaagtcaatactctgcgccaaaccacggataaagaatgaaatgatacagataacgataatcgctccgaataccgtgaatgaacgtttcatcattcccataaagttgtaattcacgttctgcatcaggttcttggaaatccctgtagtgaatgtcaagttcaaccacttgtctttattcatgaagtgctcataaacaatacgagtcaagaatactgctgtaaagaatgagcagaggataccgataatcaacgtagtggcaaaaccacggatcggccccgtaccgaaatagaacagaatgataccagtgataattgatgtcaagtttgagtcaaaaatagcagagaatgcgttagaataaccgtctgctaaagcagccttaacagttttaccggctctcaattcttcttttgtacgttcataaatcaacacgttagcatctacagccatacccaatgacaacaccataccggcaataccagacatggtcagtgcagcttggaacgaggtaaggattcctaatgtgaagaagaagttaacaaccaatgcgcagttggcaaccatacccggaatcaatccgtacatagcgcacatatagatcatcaacagaatcaacgcaacaacaaatgaaatgataccttgattgatagattcctgacccaatgacggaccaacgatatcctcctgaacgatacgtgcaggagcaggcatcttaccagacttcaatacgttagccaagtcttttgtcacctccggagtaaagttaccggtaatctgagagtgtccgcccgtaatttcaccgtttacattcggagcgctgtatacgtaaccatccagtacgatagcgatagccttgcctacattgttctttgtcagaacagcccagcggcgcgcgccgtcagtgttcatagacatactgacacaaggcttgttgaactggtcatattcatctttagcatcagtgatcacatcaccttccaacggagcacgtccgttacgttcagtagacttgatagcatacaattcaaagatacgtccctgcttgtcaaaatcagcagcctttacaccccatttcaaacgaagatctttcggcaacatttctttcacttctttcatagcaaggtactggtttacctgagcagtatctttataatcggcataacctaccaccgacccgtaaccattcggatttaattgaagaacagaagccaacggatgttctttcttcatctgctccattgcggcagagttacttgccgtttcgcctttcaatgcggctgcaagactgtcggcagcagaaattgcagaagcctgtgcaacagcaacagtatcagctgctacagaatcaccagaagcagcaccactttcaacagcaagaatatcacgcagtctgttatctacagaagaaagataaggaactatttcttttgcgtcgaaagtttcccagaattccaagttagcagatccctgcaacagttttctgacacgttccggttctttgatacccggtagttccaccatgatacggcccatctttccttccaatgcctgaatgttaggctgtgccacaccaaaacggtcaatacgtgtacgtaatacattataagagttgtcgatagcagcctttacctcttcgcgcaatactttttcaacttcactgtcggaactgcgggtggttactttgtctttcaactgctgagtagcaaataattcagccaatttgccattgggagcttgtttcttatactcttttacaaaaagagtgataaagtcatcctgactagtgatagattgttttgatgcttctgcaaccgctttgttaaaagcttcatcagtcttgttgtcagccaaagccttcactacatccggtacagaaacttcaaggataacgttcataccacctttcaggtctagccccagaccaatctccatctcgcgacactgtttcagcgtataactacccaaataaactttttcattctgcatagaatcaaggtaatgtgcttcacctttcgggtcctgtgccgctttgtccatgtgatagcgggtcacaaaagagaaagaaagataaaacacacatacaagggtgagtaataccgcaaaaacctttacaaatcctttgttttgcatgttactttgaaatttattatttttactttttgattaattcttagtttatacaaggttgcaaatatagtttttttttcacattcccacggtatcaaacacaaatatttagattccaaaagagaaaaaaggctgcaaaagcattttttgcagcctaaattattctatctcacagcctattttatttcaaacccctatttttaagcaagggctccaagctgggatcagccccacgaaaacctctgtaaagggtcataggatcttccgttccacctttctctagaatatttttacggaaagagtctgcggtatttttatcgaacactccatgttctttaaacgcttcaaaagcatccgtgtcaagaacttctgcccatagatagctgtaatacccagcagcatatccacctataatatgactaaaataagtggcgcgataccgaggagctatttcaggaatcagccccagcttgtccatcgtttctttttcaaaagcaacgacattcagattttctgtatcagtcaggttatgcagttccatatcaagcaaagcggctgccaataattccgtagtcataaaaccttgattaaaagtaccctgattttggattttcgtaatcaactcatccggaatcacttctcttgtttcataatgcttggcatagagtttcagcacttcaggttctacagcccagtgttccataatctgtgaaggaagttctacaaaatcctgcgccacactggtaccagacactccttcgtagttacacttggtcagcataccgtgcaatgcatgtccaaactcatgaaacatggtttccacctcatccaaagtcagtaaagaaggcatatttcctgcaggtttagtaaaacttgccacattataaattaaaggacgtacttcaccggcctgttcacgaaaattactcatccatgcgccaccacgcttacctgcgcgtggaaagtaatctgcatagaacaatcccaaaaatgagccatcggcatcctttacttcatacactttcacatcagactcatatacgggcacatcattcagttcggtcaatgtaatgccatacaatttgttggccacggtatacaatccgctacgcacatcttccaaactgaaatagggcttgatttcatcttcattcaaatcatacttttcctgacgcaatttttcggcataataccaccagtcccatgcagccagcttctctcccttaccttccttatccattattttctgcaactcggcggcctctttctttgcattttccagtgagtatccccacaggttattcaagaaatccatgactgtctgcgaattcttagccatgttctcatccagtacaaaattggaataacaatcgaatcctaataattttgcctgttccaaacgcaatgccatgatctttcccaatatctctttattgtcattcgcatcatcatgattcccccggttgatataagcttcataaatattttttcttagctcacggttttcagcatattgcaaaaaaggcaagcgactggagttttgcaaagtgaatagccatttcccttcttttccagcagctttcgcttcctctacggcccccgctttcacccattcgggtaacccggccaaatcagcctcattctcgataaccaactgataagcgttattctcatttaagatatgattgtcgaaagcaatccccaaagtcgacaattctttattgatctccctcaaacgggattgttttccggcatccagtccggcacccgaacggacaaaagctttataatacttgtccaacagccggtgttgctcagtcgtaagagttatcttaccttccttttcctgttgatgcacatcagccacccgtttatacaaatcctgattcaaataaatattatcactatgttctgaaagtacaggagccatcttttcattcaaggccgtcaacgaatcatttgtatccgcttcggtcaatgcaaaaaacaccccacttactctcgccagaatcccgccacttttatccagcgccacaatggtattttcaaaagtaggttcctcgggattatcaactattgccttaatttccgcattctgctcctctattcccttcaagaaagcaggctcataatgctccagtctgatcttagtaaaatcgggagcaccgtactcggtctggaattccgtaaagaacggatttatttctgttttctgttcacatgcacacattacacaacacgtcgctaacgtaaataatagtcttttcataatctgtcaattaaaggtatgtaaaatcacttctccgccacataacaccaaatggggtaatgatccgaactctttatcgtattatccaccgtacaacggtaagattttaaattcttgctcaataaaatattgtctattctgaaataaaaatgattttgattataagatatgccaaagccgtttcccgactccacaaaagcatcattcagaccttcccctaccaccctgtgagtgtatgatataggagaatcattgaagtcaccgcatacaattatgcctccccctttgtaaccggccaccaaacgagctatggaatcagcctgaacggcacgtatagccgatgcttccgccagttttctgatcagcaaacgagacccttgcgataccttttgcttatcagggtccttcatcatttcgcgatagacttctttatccttctcagtcagcttattggattccagatgattattaacaaccagcaaggtatcaccattcactttgattttataagcaatggaaccattgttaaggctggcatatctcaccggatgtgccgacaaaataggaaaacgggaataacaacccaaaccgttagcccctgatatcttataataatttttataaggataatctcttaaagcataatccacctctttcttggttaaccgtccccctacaatatattcctgcaggcagattatatccgcattgctgtttcttaaatattccaacacagggttcggattatccttggtgttcgcacggttcttctcaaaggccatcgtattgtaggataagaatttgattgccccttccggtacatcagatacaaatacattgactggaaaataagtacggatagcaccaatggaacataccaagcctaaaaatgaaagcaacgcatatttacgataaatcaccaaccaaaagaccagaaacaaaagattaacaatcaaaaaagcaggaaaagccaaaccggcacatgaccataccggatgagccacaggatcaatataagggctgtaagcacataccagtaacaataccaccatacacaagtttatgcccagtagtatccatcccaaaaaacgaccaatatatttcatatatcacttcttgctcgcatcaaacaagcttttcttctcttcggtagtcagactgttataaccagatttctttaatttatccaatatacggtctatctcctcactttgctgttttttacgggcattataatcgtaatcttttgccttatcaccataatgaactttcatcttcggctttttcgattgacgacgaaacgaaaggccttctgagaagcaatccaagcatcggtttatccatgacgtagcatcatgtccgcgggacaatccggaagcaaaccaccatccggccagagcacctcctaaatgagcgatatggccaccggcattgcccgatgtcataaacagcaaatcggtcacaaccataaacaaagccacatacttcaacctaacagtcccaataaacataaagtttactctatattccggtgcacgtaccgcagtagctacaacaatagcaagtacggaagctgatgctcccaacaaataagaataatacaaagaatcactgaaataaggaaaaacattgtaagcgatcatatacaacaaaccgccacaaatacctcccaacagatagagtccgcggaaatgctttgccgagaaaagagacagaaacatctgcccgaaccaataaagccacagcatattaaacagcaaatgcaaaatgcctgcatgcatgaacatataagtcagcaaagaccaaggctgcttgacaaactgcaacgtccaggccggcagttccaaatattgaagcacaaatgctccattccggttgaacagcatccataaaatccccaataaggaagttacaatgaatacccctacattaatatatataaactggatatatatgttccctttgttgaagctatttttcaaatcagtaataaaactgcccattattattcttttttctccaatacattattaatataaaaccaaaaatcatacctcccaagtgtgcaaagtgggcaacgccatcggtcgaagcacccaatcccaaaaatatctccaaagcagcatatcccatcacaaaatatttagccctgacaggaaatgggatagggaatacaaacatctgactattggggaatagcataccgaatgccaacaaaatgccatatatcgctcccgaagcgccaactgtagtcatcagattcaagtactccgccatcggaatcacggcaatccccgtattcacactgtcatattgcgataattcggtcacatattgtatatattgcaccagctcctgcaccaatcccgcacctataccacataccatataatagaacaagaaacgtttcggtccccaaacctgttcaagcgtacgtccaaacatccacaaggcaaacatgttaaaaaagatatgctggaaaccgccatgcataaacatataagtaatcaactgggcaggattaaaatcagatgccataaaaaagtgtagtcccagcaggtcgtttaggttaattccatacttcatggctaccacgcctccaaagaaacacaacacatttattatcaataaattcttggttactgtaggtatactgttcataaatattcttcgtctaataaaacattgattgcgcgcaaatttacaattttattctgttatataacagaaaacaagagttctcttacgtttttttgatttttggagcatcttttttaggctatctgtttgatttctaattttgaaagcatatatttgtcactgattttggtaaaacttttgtgttacatttaataattaatcattttcgttatgaataaggcagatcttatcagcgcagtcgccgctgaagccggcttgagcaaagtcgacgcaaaaaaagcagttgaagctttcgtttcaactgtaacaaaggccctcaaagaaggggacaaagtatcattaatcggattcggaacattctctgttgctgaaagaagtgcaagaacaggtatcaacccatccacaaaagcaacgattactattcctgctaaaaaagtaaccaagttcaaaccaggtgctgaactagcagacgcaattaaataattgctattttacataaaaggacttaaggaaaggggcgccggtactagcgccctttcttcttcatttttctatttgaacctatgaaacctaaaatgacaaccttatttaaatgcctgattggcgccgctgtatgcgctttttcaacacaagttcttcatgcagaagatacaaaactaccttattggaaagatattcagaccgtagccgtcaacaaggaatatccgcgtacagctttcatgacttatgacaaccgggaccaggcactgaccggcgagtatgaaaacagcccttattacaaactactaaacggtacatggaacttttattatgcagatacatacaaagatctgcctgccaacattgagcaaccggatgccaacatagcctggaaggagattaaagtacccggcaattgggaggtacagggctacggagtggccatctacaccaatcatggatacgaattcaagcccagaaatccacaaccgccgcaattacccgaagccaatccggtcggtgtgtatcagcgtgatatcgaaattcccgccgattgggatggacgcgacatattcctccgtttggaaggagcaaaatccggtgtatacgtgtatgtcaacggacaggaagtgggatacagcgaagactccaagaatccggcagaatttttaatcaacaactacctgaaacccggtaaaaactcgctggtcattaaaatattccgctggagtaccggttcttatctggaatgccaggatttttggcgcatgagcggtattgaacgtgatgtatttctgttctcacagcccaaaactcacatcaaagatttcaacgtgatgtctacgctggacgacacctataaaaatggtatcttcaaactggatgtagacgtaaccaaccatacagcaggcaacaaagaggtaaccgtagcatacgaattgctggatgccgcaaagaaagtggtggcagaaggtaacaccccctgtcctgttacagcggacgggcagaagagtatctcttttgaagccaccctcagcaacgtcaagacctggacatcagaacaccctaacctgtaccggttactgatatctctgaaagacggagaaaaaacaagcgagatcattccttatacggtaggtttccgccgtttcgagatcaaaccaaccgatcagatagccgaaaacggcaaaccatacatttgcttgttcatcaacggacaacccatcaagctgaaaggcgtaaacatacacgagcataatcccgaaacaggacattatgttcccgaagagctgatgcgcaaggacttcaccctgatgaaacagaacaacatcaacagtgtacgtctctgccactatccgcaagaccgcaagttctatgaattgtgtgatgaatatggcatctatgtatatgatgaagccaatatcgaaagccacggtatgtattataacttaagccgaggcggaacattgggcaaccatcccgaatggctgaagccgcacatggaccgtaccattaatatgtacgagcgtaacaaaaaccatccctctgtagccatttggtcattaggaaacgaagctggaaacggttataatttctatcagacctatttatggctgaaagaacgcgaagtaaaagggatgaaccgtcctgtaaattatgaacgcgccctttgggaatggaacacagatatgtatgtaccccaataccctagtgccgcctggctggaagaaataggcaaaaaaggcagcgaccgtcccattgcgccatccgaatattcacacgctatgggcaattccaatggtaatctggcagcacaatggagagcgatctacaagtacccgaacttgcaaggtggttacatttgggactgggtagaccaaggtattctggaaaaagacgaaaatggacgtacctactggacctacggaggtgattacgggaccaatgcacccagcgacggaaacttcctatgcaatggaatcgtagctccggaccgcactccgcatccggccatgacagaagtgaaatatgcacatcagaatgtaggttttgaagccatcgacccggctgccggcaaattcctggtaaagaaccgtttctacttcaccaacttgaagaagtatatgatcagttataccgtaaaggcaaacggaaaaacaattaaaggcggaaaagtatcattagatatcgaaccgcaaagctccaaagaactggacatcaacctcaacggattgaagcccaaggccggcacagaatattttgtaaattttgtagttaccaccacagagccggaacccttgattcctgcagggcacgatattgcttccgaacaattccgcctgcccatagaaccattggctatagccgaacataaagcaagcggtaagactaccgtcagcacggatggtgacgtcatcaccgtattatcatcacgtatgcagtttgttttcaacaagaaaagcggactagtgtcctcatacaaagtaaacggtacagaatatttcgctgaaggctttggtattcaacctaacttctggcgcgcaccgacagacaatgattatggtaacggtgggcctaagcgcgagcaaatatggaaacagtccagcaagaacttcaatgtagcggatgtcactacagaaacagacggcaacaagactatattaacagccaactatttactggcagcaggtaacctgtatatcatgaaatataccatttatcctgacggagtggttcatgcagatatcacctttacttctacggatatgaaagccgccagtaccgaagtgtcagaagcaactctgatggccaccttcacaccgggacaggatgcccagcgtctggcctcttccaaactgaacgtaccacgtatcggcgtacgtttccgcttgccatcggatatgaatcaggtagaatatttcggccgcggaccgggtgaaaactacattgaccgtaatgcaagtagtttcgtcgacctctaccgcaccacagccgaccagatgtacaccaacaactacgtccgtccgcaagaaaacggacaccgcaccgacacccgttgggtggaactgagccgtaaaggcggaaaaggtctgttaatacgcgctgacaataccatcggtttcaatgcactgcgcaattctgtagaggactttgattcggaagaagccattaaccgtcctcgccagtggactaatttcacccccgaagagattgccaaccacgacgaggcaaaggctaaaaatgtaatacgccgcatgacccacgtcaacgatatcactccacgtaatttcgttgaagtatgtattgatatgaaacagcaaggtgtagccggttatgacagctggggagaccgcccgctgccggaacataccctgcccgccaataaggaatatcattggggattcacattgatgccgataaaataaaaatatcgcaagcattccttccttaataagaagagtgtgtcagaactccgatggcgctatcatatagattgtcatcggagtttcatttcccatcctacatttcaattatagcctgaaagcaagatcagtctgatttatatttgctagctttgtaccccaaaaatcgaacacatggaacaacaaggagaaatcatactctaccagccggatgaatcggtgaggatggaagtgcgcattgaagatgaaacagtgtggctgactcaggcacaaattgcagagttatttgaaaccaaacgccaagctattaccaaacatcttaagaatatattccaaagcggcgagttgaacgaaaactcagtatgttccattttggaactaactgcctcggatggcaagtcatacaaaaccaaaacatacaatttggacgctatcatttctgtaggctatcgtgtcaacagcaaaaatgccactttgttccgccgttgggcaagccaagttttaaaagattatttattaaaaggtcatgtcatcaaccaacgcatcagcaaccttgaacaaagggtggatgcaaagtttctttcttatgatatgcaactgaccagattaaatgagaaagtagatttttttgtccgcacctctcttcctccggtcgaaggaattttctttgacggacagattttcgacgcatacgctttcgccacaaaccttatcaaatccgccaagaattcccttatcctgatagacaactatatagatgaaaacacacttctcatgctttccaaacgcacaacaggagtagatgccaccatctatacacaacgaatcacaccgcaacttcaactagaccttacccgacacaacaatcaatatcctcctataaacataagaacctaccgccaggcacatgaccgttttcttattatagaccgatccgacgtatatcacatcggagcctctttgaaagatttgggaaagaaactatttgccttctccaaaatggatatcccagcatctatcctcacaaaactgctataaagatgaaagaagcagaacccaataataaagtcctactaggcatgagcggaggaacagacagttccgtagccgcccttctattgcaggatgcaggatacgaggtaaccggcatcaccttccgtttttatgaaaaaggaaatgatacagagtatctggaggatgcccgcactttatgtgaacgtctgggcatcccccatctcacatacgatgttcgtggcaccttccggaaaaccatcattgactatttcatcaacgaatatatggcaggtcataccccggttccctgtactttatgcaacaactacctgaaatggcctcttttgaagagaatatccgatgaaatggggatctatcacttcgctacaggacattatgtacgccgacgcctcatcaatggatactatcacatcactaccggtgccgacccggataaagaccaatcctttttcctatgggggctgccacaagaaatcctgcaacgtatgcttctccctatgggcaacctgactaaagcccgtgtccgtgagatcgcggcagagcgtggttttctgaaagccgcccataaacgggacagtctgggagtctgcttctgccccatggactaccgcacattcctgcataaggaattgcctgaaggaagtatcctaccgggtaaattcttcgatgaaatggggaattttatcgcacggcacaaaggttatcctttctataccatcggccagcggagaggattggacatagatcttaaccgagctgtctttgtcaaagaaatcattccggcagaaaacaaagtcatactgagcgacttgaaagcactggaaaaaacagaaatgagactgaaagaatggcacatcaccaatcccgctttattactaaataaggacgacatcatcgtcaaaatacgctatcggaaacaagcaaaccgctgcacagtaaccctgcaaccggataacaccctgcatgtacaactgcatgagccactgacagccattgccccgggacaagcagccgctttttatagggatgatgtagtactgggtgggggcattatcatctaattccagacactttcaaatcatatttcggctctcttttttgctgcttcaagattttcttgataactttccgtcgtttttcaccttcaggtcgagaaaccggaaagtgaaaatagacatgtatccgaatcaaaccttaaataaatagagatgaaaagtagaaattatgcaggcatatccttacttgcctcattagccgcttgtaactctgcaacagcagaaaccgttcaaaaaaacagtacgcaagacccgaaaaagcccaatgttatcgttattctggcagatgacctgggatatggagatttaaaatgttacggagccaagaatgtagaaactccccatgttgacaaactggcatcggaaggcatccgttttactaatgcacatactgtagccgctaccagcaccccatcccgctactccttgctgacaggagaatatgcatggcgcagaccggatacggatattgccgcaggagatgtaaaaatgattatccgtcccgaacaatacaccatggcagatatgtttaaaagtgccggatatgctacagccgctatcggcaaatggcatctgggactaggagacaagacaggcggacaggattggaatgctcctttaccagccgctttgggtgacttaggctttgactatcactatatcatggccgctacagccgaccgtgtaccttgtgtatttatagaaaacggcaaggtagccaactatgatccgtccgatcctatagaagtgagttacaccaagaactttccgggagaaccgaccggaaaagataatcccgaactactgtataacctacatcccagcaacggacatgacatgtccatcgtcaatggcatcagccgcatcggatttatgaaagggggtggaaaggcactttggaaagatgagaacattgccgattccatcgccgttcatgccatcgattttatcaaacagcataaagacgagcctttctttatgtattttgcgaccaatgatgtacacgttccccgttttcctcatgaccgcttccgtggaaagaatcctatgggactacgcggagacgcaatcgcccaattcgactggacggtaggccagctgatggaaacattggaccaacttggactaactgaaaacacgctgattattctatccagcgacaatggtccggttgtagacgacggatataaggacaaggcagaagagctgttgaacggacatacaccttccggtccatggagagggaacaaatacagcgctttcgagggtggaacagccgttccggtcatcgtccgctggccacggaagataaaaaaggcaggagactcggacgtattaatgtcacagattgactggctagcctctttaggagctttggtcaacgccagattacctaaaggcagcgctccggacagctatgaccgtttagggaatttgataggaaccgataagacagaccgcccatggattgtggaacaatccatgaaccacacgttgtccgtccgtaccaaagactggaaatacattgaaccgaatgatgatccgaccactttcatgaaggcagaaaaaatagagaccggaaacctgaacgtcccccagttatatgaaatggaaaaggtgaacgaacaagagaatgtagcagaaaagtatcctaagaaagtatttgagttgcagacaattctgaggcaagtacgcaataagagaataaagatgtaaacaggactcatccaataagaggatatttcaaaagttcgaagtaactatcaaatgttccaccgtaggggcagacccatgagtccgcccctacaacataacgacaacaaaaatcacttttaacacatttacataaagtacaaaaacattccatcacagcaactcactcattaccaaccactttctgtgtaatagtctttcaaatcctcctcaatcggtatgccggtggcgaaataaatctgcttcggggattctctcggacagaatgtaaaatcaccccctcgttacctcccggcaactcgtaggcatcataagaacctattctcatcttatcttcacctcactccatttgatatttcaccaaggtgaagcaattattccacctaggtgaaagcggctgttcacctaagtgaagctagctcttcaccttagtgaagcaacgaacgcacccgaacaaaaatacgccttatgacgctcccctgcaaaggaacaaccgtagctatgacacaggaattagaacaaccgatatccgtcaaaccaaatttggcagcagaaaatggcaaaccgtttcagggggatttagaatgtatttgcgcaacatatcactgatttacagcaaagtgctgcgcataatccaagatgataatatacgtataatcaaaaaaaactcccttggtacaaccaagggaggcaggtatacatttcctttaaaagttccggatgcagttgggattataaagcagccgaagggctgctttatgtttctctatcctctgtgttagtatttaaaggaatgattcatcttttacttattacttgctttaacaaacttataaagcacgaaagtcttcggcgccatctctacattcagtacattaccctcaaccgtagcagcactttctttcggagtgatgacattcggatgctctaccgtgttatctttatccaaatcggcagactggagtgtgatgcatttaccttccacaagtttatcactcttcttcaacccgttgaaagtcaatgatactggctgtgtctgctccgaagtattggcaattttcacgatataagccttttcatccttatcccatacggcactggcaaacagaccatcctgtccttcctgaccactcacagcttttttatccatagtcaggggcaacacatgagtacctttgttatgagcataaagctgctgcacatagtaactacaagtacgaaccgagttcagattgtcaaaccagatcaaatccggacgccattgccatccttccacatgggcaaacaaaggcgcataagtagccatgtgcaccacatcagcattccgttccagtccggtcatgaacgcagcttccattaaagcagcgttaaaatggttccatttcttgcctttgccatggcaggcatattctccagcaaagaccttcggtcctttgcggtcgtaattgtcataacggttgccttgtgccaggaaccagctttcgggacgatagaaatgctcatccaccaaatccactttcagatttttcatttccggccataagtaatcaaagtctttaccttcagactgaggtcccgaactaccaacaatcttgatttcaggatgagccttacgaagcacctcgacaaactgtttcagacgttccggatattccggtccccattgttcgttaccaatgcccaagaatttcaagttaaagggagcagggtgtcccatatccgcacgaacttttccccaagtacttgtgacatcgccattagcaaactcaatcaggtctaatgcatcctgtatatacgaatcaagctttgacaggctgacctgctggtcggggtcattctgatactgacatatcaatccgcagttcagaataggcagcggttcggcgcctatatcctccgacaactggaaatattcaaagaagcccagtccgtaggtctggaaataatcagggaagaaacgatgcttgaacgtataatgccagcggttttcattcaacgggcgattctctaccgcacctactgtttttttccattcgtaacgggtagcctcatccgtaccttctacaatacagccgccgggaaaacggaaaacaccgggtttgatatcatataaagcctgcaccaagtctttacgaagaccgttcttacgctctttccaagtatctacagggaaaagagaaacatgttccagatccaccgttcccgcactttcaaggaaaatacgaagatgagccttgggctccgttctcggcgatttcaatatcacctcatattgtttccaatccttcgaattcactatcagttcttttgactcaaaagcctgacgttcctccatcgtatcattcttgatcaattcaatacgaagtttctggttctcaccacgtgcccatacggaaaagcgatactcagccccttccttgacacctatgccgaaaaaaccttcgttttcaattcctgtgtgcttttccctgtgtccggaattacccagacggacgtaatgcggatttcgctcgaacggcccgccgtccatcaaggtcacattgccgaaaatattccaacccataaaacgttgcgggaattcaaatgaacggttctttatcagttcggcatacaagcctccgtccgccccataattaatgtcctcaaagaacaaaccatacatggttggttgtatttccgcacctaatttattggtctgcacgaccatgttgtgcgcattctgtgcatgtagcgctactccggcagcaaatacccatgctgtgaatagagttctgtgtaatttcatgatagtaatattattgatttttattagtcaattctctttccccacacagaatgcccttgagcatccaggccggtaaaaagaatggtttctgtttcattttcccaatcgtgtccggcaaagataatcaaattgttaatatcttctgtggctgtttttatagtaagaagttgttttttaacattaaaatcccaagttgcatctccaacactgccatctgcttccaaaacaacacgggcagataacgcctgctccccatttcgcaagtccccttcaccccacaatatttgtccagcttccaaactacgttccaaaggcggttcctgaatacggataatttcccactcacctaccaaatcttctttagtgaaagaacgtggagcagtacctgcatagcgttcgggagaaaccacaggccatccattcaccgtaaagaacacttcgcgcacatgcaaatccatcaactggttctggggggaaagccgtccctgatggaccataaaataacggccgtcaccggcatcaataagaccgcaatgagccgttcccgcccatcccggatgattttcgaagcggtaaggagctgtcaatataggaacattattcgttgtatcttttatatcctctccgtagaaatccacaaaaggtccttcgggagaaccggaataagcgacacgtacattataggtagtcatcagcggatcgtaggatgtaaacagataatatttgccaagttggggttgatacatgatttccggcgcttccaagttatctttccggtaattggcccggcgtgctatcaagtgcccatgatcctccggctgcatagtcattcctgtttcgggattcagttccacacagtacagaccaccgaaataagagccatagtgcatccaccactttccggtttccggatcctcaaccacagaagggtctatggcattcatcgcatccccttctcctgtcttaaccacacaccctttctgtatccagggaccttcgggagaatccgactcggccataccgatataggatgtattcctgccgaatgccgaaacacaataatacaaacgataaataccctgataaggcatcaaataaggagcccagatattagtcgccccttttccctccgcctgactatgaacccattctatagccggagcaggaatctcgggaaaagcccagcccacaaaatcccaatgtaccaagtcttttgatttgcgtacctggacaaaacccagaggcacattcttctctttcgcctctttccggttctcagcaaaaatagcatcggtagaatacaaataataagtatctcctatttttttacaagccgggtcgtgtacattatatgttccccactgcttgtaattctccatagatgaaagagcggtataatcatcagcccaaggattgggagaagggacaggcacgaaagccgtaggtgcactgcatgataccaatatccctacggccaacaagcctaaaccgaccaacctatttattattaaccttttcatgtccatgaataatctttgagggaaaaattgctgtttcatagtatttttttattatgtgaccatttgctaatgtactaatttgtcaatgacatgcggcatataacgcagccaactgtcacattgactaattattattaatgcaaatataactgcaatcaaaagctcgccaggtggacaatatcgcttaaagggtggacatttgtgcagcagagggataaaaatgatttatttgtttttgaggaaaaacgaaaaggtatatctttgtataagtaacggtatattcttacgtcattaatgaacaacacactatgaaaaaacattgttttctattcgctctgttcatctttttatctagtctgtatatgcaagctgaaggaacagccggaaaatggtccgaacgttataatttcactgccattacgatggatgaaggactgcctcacaactttgtggatgatatattgaaagacagtcagggctttttatggatcgctacccgcggggaaggaatcgcccgttatgacggttatgaattcaccgccttccatatgggaaacacccgtatcaagctacgaagtaactttataaacaaactgtgtgaggataacttcaagcgtatttgggctgtcagtgaaatgggtattgacatactggatatacaaaccatgcagacagtacaagtcactgatatgaaagacaaacttatttcactgtgtaaccgcccctctcatcttattctccatagcaaagcgggaaatatttgggtttgttcggaaaacaatttattcaaaattacctttgacaaacaaggagatataaaacaaatcattaaaacatgcgaagtaccggcaggagaatccatccggactatttgtgaagtagaagactatctctggataaactacaaagacggtatctaccgcatcaaagaatcggctatggaagtacaggaacccacattcatttcatctgcccttcaattacccggtgtgtccatacaagtaatctgccggaaagaaaatgaaatttggattggcagcgcacaaggccttttccgatacaatatggatacggaactgatgaagcattatatgtatgatccgaatgacaatagttcgctttcccaaaactttatcacagacatagcagaaacaggagaacataccatgctggttgccaccctaaaaggtataaacctttataatgcgttgacagacaattttgagcggataaataaagataccggagaaggagaaattgtacaaaacacattgaactgtgacttcgtaaactgtctgctgaccgatggtgacattatctgggtaggaaccgaagtgggagggctgaacaagatgagccgccggatgctgttggtacaaaactattatcatattcccaccattcccggaagtctttcccaaaatcccgtcaatgccatttatgaagacccgtcgggtgttttatgggtaggaaccgtagaaggaggtttaaaccggcgagctcccggcagcaacacttttgaacactataccactgatgcacccgcccacctaagccataataccgtcagttgttttaccagcgataacgatggaaggctctggataggaacctggggaggaggcataggatggatagacatgaaaaatccgcagaacaaacaattccaccacatagaaatacccgaatacggagacttctcatggggatgggccggaagtatctgctatgaccacttgaataatgccatctgggtgggaaccagtaccaatatctatgtttacgacttgaaaacacaaacgctcaccgaaccattcaagggtatgaacctaggtggaattgaaggctgtacaggatactatatagataaggataaccacctgtggctgggacttacagaaggactttgccgaatagatctaagcagtttgaaagcccctagactgatttatcaactctggaggatcaagctggacgaaccggaatcaaagttgaaggaaagggtaacctacatcacccagtctaaagacggaaccctatggataggcagcaacggatatggtttctacaaatcctcaccaacagaaaacggagaatataccttccgctccttcaccaccgaagacggactgataaacaacagtgtccgctgcatatcggaagataaagaagggtatctttggattaccaccaccaacggactctcccgcttcaatcctaacaacaacagcttctttaactatacccggaaagacgggctattatccaaccagttctattggaacgcaatatgccgtgccgccaatggagatttatatataggaagtaccaaaggactgtctgtggtcaagccggtcatagatataaacccgaaggaagctgttcccttggcgtttacccatgtccgtgtggcaaataaagagcgattgtacacaaacggtaccctacagttacacgaacgcgacaaatctctctatattgaatttgccgcactggattatgatgcatcgacattcgccaattattattaccgcttgaaaggatttgacgacaaatggataaaagtgccggccaacaggcgacaagccgcctataccaatctgcgtcccggcaactatactttcgaactgcgttatgcccccgacggcaaacaatggctggaagaaatggcagaactccacattgccgtatcaccttatttctataaaaccatctggttcattctgtccatattggttcttctatctttccttatatataaggtattatcatggaggcttcgttcattaaaagaacaacaagaaatgctccacatcaaagtagaggaacgtacccgtgaactggaagaacaaaaaaaactgctttccactcaggcaagcgagctctatcgtcaaaaccaactattgaaacagcaaaacgaaaaaataaccaaacaaaaaggacaactgatacaaatgtcaaagaaagtacaggaattgacggttgacaaactcgccttcttcaccaatatcacccatgaattccgtactccgttgacattaatcgtaggacctatagaaagggcattgaaactaagctacaatcctcaagtcattgaacaattacattttgtggagcgcaactcaaaatatctgctctcactggtcaaccaattaatggacttccgcaaagtagaatcagggaaaatggaaattgtccgcaacccgggcaactttgccaagttactcaatgaactgctggttcccttcgacgcatatgcatccgaaagaggaataaccatcgaacgtcgtttccgccttccttcatgtgaaatcatgtacgatgaggatgccatgcataaagtgattgtcaatttgataggaaatgctttgaaatttacccccaaaggaggacaaattaccatctatgccacccccttccgccaggaagagcaggaaaagttgttcatctgtatccgggatacaggaccaggacttcccgaagaagagatagacaaagtattcaaccgcttctaccaatcacaaaataagacgcattcctctatcaacggacaaagcgggactggaatcggtctctatctatgcaaacgaattgtccagttgcatggaggttcaatttgtgccaagaataatcagagcaaaggatgttctttccgtattttacttcctttgcaatatgccgatgcggacagtctgcccacaccaacagagcaagttaaagaaccggtcgactctccgatgacattgcaacctgccaccaatggaaaactgacgattctggtagtagaagacaacaaagatatgcgcgactatatccgttccatcctgaccgaatattataacgtacttgaagcatcccaaggtgaagaagcattgactgtgctccaatcccaaaacgtggattttattgttagcgacctgatgatgcctgtcatggatggcatggaactgtcccgccgggtaaaatccaatttcgccatctcacatatccccttcctgatgctcacagccaaaacatccaacgaatcgcgcattgaaagtttccgtataggtgtagacgagtaccttttaaaaccatttgatgacactttgctgctggcccggatatccaatatactggaaaaccgcaaacgtttccaacaaaagttctcatacagtatggacgtggatgcactgaatatcgaaaaagaatccagtgacaagaaattcctggacaaggcgatgcagattgtgaaagaaaactataagaactcctattacgaaataagcgatttcatcgaagcaatgggggtaagcaaaagtttgatgaacaaaaaaatgcaaaatctgacgggacagtctgccggacaattcatgcgtaactaccggctgaatcttgcgcgggaacttattatccgtaaccggctgacgcacaatatgaatatatctgagatagcatacgaagtaggattcaatgatcccaaatacttcacacgctgctttacaaaacatttcggaacaacacccagttcgatgatggagaatggaaccgactgacttattccagagcgtaaaatgaacggattgtataccataaatgctccgtttttctacgctctcgtttcgctaaataaattatctttgccctacattataatagcatatttaatacccatgaaaaaacaatttatgacttggctgcttgccatcactacaatgtcagcttttgctcaacaagctacagttacaggacccgactcctttttaagagtaaatgtatccgtaaaacaaggcatccccgtttattccgtcacctataaggacaagaccatcctggaagattcacctttaggtttcattgccaatgtgggggacttcagccgggatatgactttcaccggacaaaaagagaataaaatagataaaacctatacacaagaccgtatcaaacaatcacaaattcattatcaagccaatgaacttacatgcacctttaccaataaagaaaagaaaaatataaatataatattccgcgtaagcaacaacgatattgctttccgctacgaaatgcccaaatatggcgatacaggaagcatagtgatagaaaaagaaacgacaggttttgacttcccatccttcaccactactttcctgtgcccgcaaagtgacgccatgataggttggaaacgcaccaaacccagctatgaggaagaatataaggctgacgctcctatgaatgtacgttcacaatatgggcacggttacacatttccttgtctgttccatgtaggagaaaatggctgggcacttatcagtgaaaccggagtagacagcaaatactgtggctcacacttaagcgatgctactgccgacggactttataccatcgctttccccatgcccgaagaaaacaacggtaacggcacggcatctcccggccttgcattgcccggttccactccctggcgtactattactgtaggcgaaaacctgaaaccgattgtagaaacaacgattccatgggatgtcgtggaacctctctacccaacggagcatacatacaaaatgggacgcggaacctggagctggatactttggcaggatggaagcatcaatttcgacgatcagaaaaaatatgtagacctcgccgccgccatgggatatgaatatgtattgatagacaactggtgggataccaacatcggccgtgaacgtatgaaagacttcatagactatgcacacagcaagaaggttgatatatttttatggtatagttccagcggctactggaatgatatagtgcaaggtcctaccaactatatggacaatcccattatccgtaaaaaggaaatgaaatggctgcataatataggagtaaaagggatcaaagtagatttcttcggaggtgacaagcaggaaaccatgcgtctgtacgaagccatcctgagcgatgcggatgatcatagactgatggtcattttccacggctgtacccttcctcgcggatgggagcgtatgtatcctaattatgtaggaagtgaagccgtgctcgcatcggaaaacctgattttccaacaacatttttgcgatgaagaagcatttaatgcctgtctacatccatttatccgcaacaccatcggttgcatggagtttggtggcacattcctcaacaaacgcctcaaccgcaacaatgacggcggaagcatacgcaagaccactgatgtattccaactggcaacagccgttttattccaaaatcctattcagaattttgcgttggcgcctaataacctgaccgatgcccctcaagtttgtttggatttcatgaagcaagttcccaccacatgggacgaaacaagattcattgacggctatccgggcaaatacgtagtactggcacgccggcatgccgatcaatggtatatagccggaatcaatgcacaaaaagaaccgctgaaattaaagttgaaccttcccatgtgtactaaaggagataaagtgatgctttatcaggacgataaaaaactaaatcctcacgctgaagagataacattaaaaaagaatgatgaaatcagcattacgatgcaggcggaaggaggatttttacttgtgaaataattcctttcagagaattgtattttatccctcatgtagccgggcagtccttcatcaggttgtccggctacatgattttttataaaaaagccttctcctgagcctatctcaccgcctccaaaagacataaactataagcgaaataaatacattttttcccattattcattcgtccaccctataaaaccgtttgtccacccctgtttacggcataaattttacttttgtcatgcaatcggtactcaactttcggaagagacccctgcttttaaaatttaatcctaatcttaaatattatgaagaatagctccagcatatttataaactctgtggtttgtctacctagagtattcaacattggattgtacaataatccaacatctcaattcaatatatcagcaacaatttaatctactaatttaatacttaaaaaaatgaggaaacatttattattttccgtaatgcttagtctgtgtgctatgggtggcatgatggtgtattccacacctgttatggctaccgtggcgcaatctccgactatcaaggttcgcggtcaagttatcgatgaacaaggtgaacccctcacaggggctaccgtcagaatcaaagacggacaaggcggaaccattaccgatgtggacggaaacttccaattggaggttgccggtaacgctatcctttcgataagctatgtaggctacaaggatcgtgaagtagctgttcgcaaccgcgccatcattgaatccatccaattgcaacccgacaatcagatgcttgagcaagtagttgtcatcggttatggtacacagaagaaatccgacttgactggttccgtagccgtagtagatgcggaagccctgaaacagacatcccattccaatatctccaccatgctagaaggtaaagtatcaggcgtacaagtcacctccgacggacagcccggtgcagaccctaccgtccgcatccgtggtgtcggatctttcggtgacacttctcctctttatgttatcgatggtgttcctatgggtacctccatccgcgatttctcttcaaacgatattgaaaccatccaaatcctaaaggacgcatcagccgctgccatctacggttcgcgcgccgccaatggtgtggtcatcatcactaccaaacgcggtcagaaagaccaaccgctgaaagtagattacaatggctacgtgggtatggactatatccccagtaatgtctatgatgtaatggatgccgaccaatacagccaatacatcggtcaggcatgtaccaactccaacactccgctgcccggcggttacaagctggacagtaccaccggaaaatatcatttccaggacaacaccaataccaactggtttaaagaagtattcaaaacaggtatccgtcagaatcacaatgtgaatctctccggtggcggcgcccacaacacctataatgtttcattagactactacaaccagaaaggaacactggaaggcgccggtcctaactatgaacgttacacggcacgtgtcaacaacacgatggacaccaaattcatcaagttccataccagccttgtctactctcactccgatcaagacaacatggggttgtcaaacgcttccgaatacgttcaaggtctgtatggcgacgtaaccaatgtgctgcgtggtactttgctgatgcagcccaccatcaaagcctatgacaactctacttgggtacttgacaatctggtaggtatcgccaataacttcaactatgactcttacggctatggtgtttactacgatactgtacatggtgacatttcggcttccaaccccttgctggtcaacaatctgctgaagcgcaacacccgcgtggaccgcttcgtaggaacagcttctgccgatgtggatctcctgaagatgattggcgttgacagcaagaatcacaagctcaactataaagtcaatctctcttacagcaaaacccattgcaaggacttcacctggattcccgcatgggtacagagcaatcgtgtctatctggccaagagcaacgaacgcctcaccaaggctagccgttcttatgccgatgctttgattgaaaacgtgctgacttatgatgctaccgtcggcaaacaccattttaacctggtagccggccagacttacgaagaagaaaacaccgacctgttgacaggctggggcgtcaacttcaccgagccttacttcctgcaacttcagaatgccgccaacacttatgccgaaagcttcgaatacaaacacaccatcctctcttacatcgggcgtatcaactacaactacgatgaccgttatctgttctcggcaaccgtgcgccgcgacggcagttcccgcttgtccaagaatatccgttggggtactttcccctccgtatctttaggatggcgttttgacaaggaaacttttttccctttcaacagaaacattgtcaacatgttcaaggtacgcgccagctatggtgaactcggtaacgaaaacatcggtgaatacatgtatcaggctgtaatggcacgtaacaacatgacttatagctttggtaacacacccatcaccggttctgccatttctactttcgtagacaataacctttcttgggaaaagaagaaaagctacaacgtaggtatcgacctcgccttcttcaacaaccgtttggaattcaccgctgaatggtacaaaaataccagtgaagacctgctgtatgccgttccagttcctgagcaagccggtgtatccaacaccactgtaacgatgaacgccgcctcgatgaataactcaggttttgaatttacgactacctaccgcaaccgcgaccacgacttcaaatatgaagtgtcagccaacttgagcaccatccgtaaccgcgtaacctcattgggcttcggtaccgattcatatatatccggtgcctacatcaccaacgtaggtgaagaaatcggtaagttctacggatgggtttatgacggcatcgcccgcacacaagccgacctggacaaccatgccacacaagaaggtgcccagattggtgactgcctctataaggacgtaagcggtcccgacggaaagcccgatggaaaggtggatgcctatgaccaagtagtactgggcagcggtatgcctaagatcaacttcggtttgaacgcccgctttgaatacaaacgtttcgatctgagcatcgctacgttcggtgcactcaactatcacgtaagcgatgatatccacaactctctgaactcctgctacggctggggcaacaaagatgtagccatgcttgacgcgaaccgtttcagtgaagacggcagtacctatctttccaacgtgccacgtacctatgttaccaacagtgccagcttggcctggaacgatctcttcagcgaccgcaaaattcagaacgcagcttattggaaaattgccaatatagaattgggctacaacttccccaacgaatggtttggcaaatacatatccgacgtacgtctctatgtgtcagcacagaatttacacacattcaccgggtacaaaggttataatgtagactatgcaggaggcaccttcacaccgggatataacttctgttcttatcctaccgcacgtaccttcatgtgtggtgttcatttcactttctaatcactaaaaacataacaatatgaaactcaataaatatgcattggctctcattttgggattaggcacattggcttcttgcaatgataatttggagctgttgaatcccaaccagcaaacctcaaacacattcggcttcaatgccgatgatttggaagagagcgttattgccgcctataaccatatccgtatggaaggttcttacgcccgtgtaggctacaccatcgacgtgtgtcgtggtgatgaagcatggaactcatcacaagtatggtatctgcctttcgatgacctgaatgcggaagtaacctcggacatcacgtggtggccctggcgcgaatggtactataccattaatgtatgtaattttgccatttcccgttgcgatgaagacaacagccagctttccgagaaaatgaaacgcatcaaaggacaagtactcttcctgcgtggcctgtcatactacaatctggttggttattaccagaacccacccctcatcacagattatgctacctattcttcattggatggactttataccggcaacagcacatacgatgccgtactcgaccaagtggaaagtgatttcaaagaagccatggaattgttaccctcacgagatcaaggtggtgaatgggaaaaaggacgtgccacctgcggtgctgcagccggctactatgcccgtgcgctcatgacacgccataaattcaaagatgcccttactgtgctgaaagacattatcggcaagaaatatggtacttatgaactgatggataactatggcgacaactttcgtgaaggtcctgcctatgagaacaacaaagaaagccttttcgaagtgcaattcctcgacttggaatcacaaggaaccgatgacgagtggactccggtgaacaccagtccgaatgccacccaaggttcggccatcgagagtaacttcgctcccggcaattatggtggttgggcagacatctcggcatccccgtggctctaccatctcttcaaagctgagcgtacaactgacgggaaactcgacccacgtctgtactggaccatcggtacttatgaatccgactgggaagatttcgagttcggtaatgtagcttatacgaacaagcttacagccactgacaacatcgtaaccaacaacacatacggtggtctgcccatcgccaagttcacaaaccttcgtaccggtctctatagcacggttattacaggtttgcacgatggaatcaacttgcgtctgatgcgttactccgatgtgctgctccgcgccgccgaatgtgaaaacgaagtcaacggccccacacaacaggccatcgactggattaacgaagtgcgcaaccgtgctgacttgcccgaccttgaactggctgacttccctacagccgacaaactcttcgagcagattgccaatgtggagcgtccgaaggaattcgggtgcgagttcggacgcggattcgaccttatccgctggggattcttctataagaatgaccgtttgcaacaactcaaggaacacagcgtcgtacgccgttctttaatcggaaccaaggaccctgtaaactacaacgatatcacaaccgatcccgaactgaaaagttctttcgacacttacttacccggacacgaattcctgcccatcgtacagcagttgttgaacaagaaccccaatttgagtggtaactccgcgaacttcagcacagacaactctacttatttcagtgaaaatggatggacagttcgtccggttgttgacttaagcaaataaacaaacctattaaaatttaagacaatgagaatactcagaaaattagtatacgtttgctgttccatcaccttggggttgatggcattgtcaagctgcgagggtggcgagttatatgatgtaaacgcccctgactggatctccgagaaagtggactctatagcagattcaaagaaagagccggaagaagaagtactggaaggtatgcaggaagatgtctactccttcggtaacacagactacacctccggtttctggacagctttctccaagtattacgtcgtgcccgacgggcagaaatggcatggggtgttcaatctcaacatcaatcccgccgacaatacctattataaaaacttcgccctcgtcattaccaacgatacagaccgtggaggagaaggatatacggaatatggtgcttatcgttttgacactacaaacgatactttggcctataactcccaatggggttcccatctttttttcaaatacacatccagcacgctgatgctgtcacccgttgataatctggacgaaactgtacagaaattgggcggcaaagtgacactcaccgtagaccgaaccagtgaaaatgccttctctatcaaaatccagaacgcctcggcaaccaaaacctacaaacagccgtacaagttacccaatctgaatatagacaagagcaataccaacatccgctgtttcctagtacctgaaggctcttatatcaacttcttacaatcaaacatcattcctatcggtggccttacttctgccgaggacaagaatccgctctcgatggtactgcaaaatgtacccgatcaggtcaatgccggcacttcactcgaagaagccgtggtcggtattactgccgtcgtcagcttcgaagaaggggtgactaagaccgtaaccgccgaagaactccagttcaccgccatccccaatatggaagaactgggtacgaagacactggtagccatctataacaagaccttcaagggtgagaattgcaacttgccggtggtagccaatgctacgtttgaagtagtggaaaagattgtatccatccaagtgacggctcaacctacacatacacaatattactattatacttcggctgcaaccgaggcgatgacggatcgtacgctggcattccttccggaaggattgaaagtaacggctacttatgccgacggaagcacccaaattattgacaacacaaaactcagtttctctgccattgtcgccaaagccggtacacagaccgtaaccattactgccgatgaagctaccgctaccgtagcagttaaagtggccgaatcaacagtttccactgtcagcaactctgcagacattctgggaaccgaagacaatacaacggagtggtggactgtcttttctgacaatttcaacgtgccgatcggtgaaactaagtccatcagcttcaccaattacaccagcctggctaataactggagcaacttcgctgtcgttctccgcaaagccgatcttgccgaatatgcagtggtacgcgccgacaactatggatggggtgcaggatacgatggaaatgccagcctcgttcacaacggtacacaaggcgactgggctacttggcttgccgatatgaacggagccaaagtcaccgtctacgtgaccaattgcggcaatggtacaaccgacattcaggcggtaatggaaggcacttcaggtacctcctatgcccaatactatttagggatcaacaaagtagatatgaacgacttgaacttcgctttaacgattgaaggcggacatctcgtcttctaagccgaatcagtaatcacacaaaccatgccgttttcctcaggaaccagaagaagcggcatggcctttaaactatcaacagatgaaaaaactattatccctgtggatgttcttaccaatattccttgttttagccgcttgttctgacaacagcgaagatatagaccgctattatgcaactgtaagtactccgaaagtaactacaaccacacccacctcattgaccgtcaccgcgtcggttacgggtgatctgaaccaaatagtcaagaaaggcttctgttacagtacagcaacttccacaccgactatcaaagaccacgtggtgaatgccgatgagaatttcagcgccaccctctcaaccttgaccaccggtacctcttactatatccgtgcatacgtctactgtgacagccgctatgtctattctgaggtgatcacggccaccacagaaagcttaagcttagacgatgaactcaagaattatgtggcccccacctacgccgatgactatacctcgataagtgactggagcaaacgctctcaatggaatcttgccaacgtacacgacccctcggtggtattggccgaaaatggttattattacatgtatcagacagatgcttcctatggaaacgcccacacggcaggcgggcacttccacagtcgtcgttccaaagaccttgtcaactgggaatacctcggcggtacaatgaagaacctgcccgaatgggtagtacctaagctcaatgaaatacgcaaagaaatgggacttgccgaagttaaccctaatattaatgacttcggctattgggctcccgtagtacgcaaggtaaagaacggcctctatcgcatgtactattccatcgtctgccctggcacactcaacggtgccaacacctggtcggagcgcgccttcatcggcctgatggaaaacaacgaccccgccaacaacaacggctgggtggacaaaggctacgtcatcaccaatgcttctgacaaaggacttaacttcaacataaagccaaatgactgggccaattgctactacaaatggaatgccatcgacccctcttacatcatcacgcccgaaggcgaacactggttggtctacggttcatggcatagcggcatagctgctctcaaactcaatggcgagacaggcaagcctgccgaaactttgggccagccttgggctacaggccaagcacctgctgagtatggtcagttaatcgccacccgccagacaggtaaccgctggcaagccagtgaaggtccagaaattatttaccgtgatggctactactacctcttcctggcctacgacgcccttgacgtgccctacaacacccgtgtagtccgttcgaagagcatcactggtccctacgtaggcattgacggcaaagacgtgaccgccggtgccgatgcactgcccatagtgacccatccctataaattcagcaaaggctacggctgggtaggcatcgcccactgtgctatcttcgatgatggcaaagacaactggttctacgtctcacaaggtcgcatgcctaaggatgttccgggcatcaacgccagtaacgccatcatgatgggacatctacgcagcatccgctggacgaaaaacggttggcctctcgtaatgcccgaacgttacggagccgttcccaaagtagccatcaccgaagaagaattgcccggcaattgggaacacatcgaccttacatacaaatatggagagcagagaacttcagcaacaatgaccctcgccgccgaccacactatcaccgaaggtacctggaaaggcagtatgtggagctatgacgccgaccaacagattctgactgttaacggagtggaactttatctgcaacgtgaaaccgattgggaagccaatccacgtacccataccatcgtctatgccggctatgccaacaacaagacgtattggggaaagaaatccaaataacattcccgctcccgcacgcaaacttcatatagaaacaggaccactgcccctcaaaacaacaccaatgtttatggggcagtggtcctgttttacaagtcaatagcagaaattaaagatcattaaacagatacaagagaaacctatttcatgaaaaggaaaaagagttaggttccctaatctccatacaaaaaatcattattttgttcttttacgttcaaagacaaccttttatcctaattcttacttttatttatcaccataaatctctattccttaaaccaacaaacatcatttgtagacaagcagaggacaccagcatcagattttttgttaattattagccaaatacacactttaatttataactttgcaattctaatagaatgaattatggaaaataaactaaccatttacaatacattaagccgtcaaaaggaacttttcgttcccttgcatgcccctcatgtaggtatgtatgtatgcggtcctaccgtatatggcgacgcccatttaggacacgcacgtcccgccatcacgttcgatatcctgttccgttatcttacccatctgggatacaaggtacgttatgtccgtaacattaccgatgtcggtcatctggaacacgatgcagacgaaggtgaagataaaatcgccaaaaaggcccgtttggaacaattggaacccatggaagtagtacaatattacctcaatcgctaccacaaggcaatggaagccttgaatgtacttccacccagtatcgagccacatgcatcaggtcatatcattgaacagatagagctggtagaagaaattctgaaaaacggctatgcttatgaaagtgaaggttccgtttatttcgatgtagcaaaatacaacaaagaccatcattacggcaaactgtccggccgtaacctggacgatgtgctgaacaccacccgcgaactggacggtcaaagcgagaagcgtaatcctgccgatttcgctctgtggaaatgtgcacaacccgaacatatcatgcgctggccaagcccgtggagtaacggttttcccggttggcattgtgaatgtaccgcaatgggcaaaaaatatttgggcgagcatttcgatattcatggagggggaatggacttaattttcccacaccacgaatgtgagatcgcacaaagcgtggcttcacaaggagatgacatggttcactattggatgcacaacaacatgattaccattaatgggcagaagatgggaaaatcatacggcaactttattaacttggatgagttctttcacggtactcacaagttactgacacaagcctacagccccatgaccatccgtttcttcatccttcaagcacattaccgcagtacagtggacttcagtaacgaagcattacaagcagccgaaaaaggattggaacgactgacagaagctgtaaaaggtcttgaacgcatcaccccaagcgcacaaaccaccggcatagaaggcgtaaaagacttacgtgaaaaatgctatacagccatgaacgatgacctgaactcaccgattgtcatcgcctatctgtttgacggcgcccgtatgatcaacacagtgcttgataaaaaagcgaccctttccgccgaagatctggaagagctgaaaagtgtgttccatctctttatgtatgaaatcttgggtataaaagaagaagccgccaataacgaggcacgtgaagaggcatatggcaaagtagtagatatgctgctggaacaacgtatgaaagccaaagccaataaagactgggctacaagtgataaaatccgtgatgagctagccgctcttggctttgaagtgaaagataccaaagatggtttcacatggagactgaataaatagaatacgtagagcggtactatattttttcaccacagactatacagattcacacagattatccaacctaacaatcaatgatttaagaagcatctgcgtttatttgtataatctgtggtgaacctttcagataaccatcaaaactgaaaaatctcccttcggatggtaatacttatttttaaataactatttttgcagaaactatacaaaactgcttatcacaccaatccaatgctagttgagaatacaataactttagcgtccctatataagattttgtttgaagaagagccactgacactctccgacccatgtatgcaaaaactggaagagagtttcaatttcctgaaaacattctccaacgacaaaatcatctatggcatcaataccggctttggccccatggcccaatatcgtattgaagatgaatccttatcgcaattacaatacaacatcatccgcagccatgctaccggagccgggcaacctcttccggaacgctatgtcaaagctgccatgatagcgcgtctctatacttttctgcaaggaaaatccggcgtacataaagaactggcgttgctcattaccgagtttatcaaccgggggattattccatacgtacccgaacacggcagtgtgggggccagtggtgatctggtacaactcgcccatatcgccctcactctgattggagaaggagaagtcttttaccaaggcacgaaaagagatacggcctctgtgctggcggaaaacggattgcaaccttttcaaatgcacatccgcgaagggctttcagtgaccaacggcacttcagtcatgacaggtataggtattgtcaatctgatttacgcacgccaacttatgcaatgggcggtaggtgcatctgttatgatgaatgaaatagccgcctcatacgatgacttcatgtctgaaccgctgaatgaagccaaacagcatgaaggacaacaagagatagcccgcatgatgcgccaatgggtaaaaggcagcctgtgtgtacgcaaaagagagaatgaactttataatgggaagcacgaagagaagatcttcacccataaagtgcagccctattattcgctacgttgcattccacaaattctagggccggtttatgatgaattactcaatgctgaaaaagtattgataaacgaaataaattcagcttgtgacaacccgatagtggaccctgacacacagaatgtatatcatggtggtaacttccacggagattatgtatcttttgaaatggacaagttgaaaatagcagtcaccaaactgacgatgcttgccgaacggcagattaattacctgtttcacgaccgcatcaacggcattctccccccctttgtcaatatgggagtactggggctgaattatggtttgcaggcctcccagttcacagccacctctaccacggcagaatgtcagactttgtccaatccgatgtatgtgcatagcatccccaacaacaatgacaaccaggacattgtaagcatgggtaccaattccgccttgatggcaaaaacagtcattgaaaatgcttatcaggtgatggctatcctgatgatgggtattgtacaagccattgattgcctggatatagccgaccggataagcccccggtcacaacaagtatataaagaaatacgagcatttttccctgttttccgggaagatacacctaaatataaagagatagaaagcatgatggtatatcttaaaaaagggaggtttcaagaaaaatgaaatacgcattagtaacaggaggaagccggggaatcggacgagccatttgtctgaaactggccgaaatgggatatcatatactgataaactaccaaagcaacgatacggaagctgaagccaccctgcaacaaatacgggaacaaggctcggatggcgaactgatgaaatttgacgtgacagatgcagcagccacacacgccgcactgaacggatggataaaacagcatcccgatacttacattgaggtactggtgaacaatgccggtatacgccgtgacaacttgatgctgtggatggaacaggaagaatggagccgggtactggatatcagtctgaacggtttctttaacgtcacccaacccttgctgaagaatatgctggtaaagcgattcggacgtattatcaatatcgtttccctgtcgggcatcaaagggatgccggggcagaccaactattcggcagccaaaggtggaatcatagccgctaccaaagcgttggcgcaggaagttgccaaaaaacacgtgacggtaaatgccatagcaccgggatttatccgtacagatatgacagacggaattgatgagaacgagtggaaaaaacacatcccggcaggacgcttcggcgagcccggggaagtagccgcactggtaggcttcctggcatccgggcaagcttcctacattaccggagaagtgatttccatcaatggaggattatatacgtaagcaaaagatgaaaagagtagttattacaggaatgggcatctattcgtgcataggcaggaatcaagaggaagtgaaagagtcactgtttcaaggaaagtcaggcatcggaatcgctccggctcgcaaagaaatgggctatttctcggcgttaaccggtcttgtcgaacgtcccgatttgaagaaattattggaccgcaagaaacgccatagccttgccgagcagggagaatacgcctatatggctaccctggaagcattccggcaagcccggatagaagaaaagttcctgttggagaacgaagtcggaatactgtatggcaatgacagtagtgctgctccggttattcaagcaatagatattatccgcgagaaaaagaatacggcattggttggttccggttctattttccagtccatgaattccaccattaccatgaatctttcggttattttccatctaaaaggaattaacttcactatatcgggagcctgtgccagtggttcacacgccatcggcatggcttatctgcttatcaagtcaggacttcaggactgcattctgtgcggaggagcacaggaagtgaacccttattccgtgggtagtttcgacgggttgggagccttctccgcccgggaagacgaaccggaaaaagcatcccgtccattcgataaaaaccgtgacggactagtacctagcggcggaggcgccagtctggtgctggaaagttatgaatcagccgtaaagcgcggagcgactatcctggcagaagtcataggatacggcttctcatccaacggagatcacatttccgtacccaatgtggatggccccagacgctctttgcagatggcagtcaaggatgcgggtattcctttggaagagattgcatacatcaatgcacatgccacatccactcctgtaggtgatttgaacgaggcaaaagccatagcggaagtattcgggagccatcatccctacgtcacatccaccaaatcacagaccggacatgagatgtggatggcaggagccagtgaagtcatttactccactttgatgatgaacaacggcttcatcgcacccaacctcaattttgaggagcccgatgaagcctctgccctgctgaatatcccttcccgaagggtagaaacggaatttgacacattcttatccaactcattcggattcggaggaaccaattcctcactgattatccgcaaattcaaagaaaacaattaatttaaaccaatatataaatttatgaccaacgaagaaatcatcgaaaagatcagaaccaccctggccgaagaatttgagattgatgtagaattgattcagccggacgcccctttgatgcaaaccttggaattggatagccttgatttggtagatatggtagtactgattgacaggaatttcggtttcaccgtgacagccaaagactttgccggtatcaaaaccttccaggatttctataatctggtaatttcgcacatacaaaaagaagactgatgcccgaaacatggaaaggtaaaacaagaggaggtacattcggatacatgttcttcatctacatgattcgctgtctgggtatcactgcggcttacggctttctgtcattggtcgtcctctattttatacctttcgcaccgaaagctaccgccagtacctggcaatacgcacggaacagactgaaatacggacgtgccaaagccgccggactgttattgaaaaattactaccggctggggcagatattgattgacaaagtagccatcggcaatgggatggcagacaaatatcatttcgagttcgagaactatcaggcatttttgaacgtactgaatggaaacaccggcgtaattatgataggtgcccatgtaggtaattgggaaataggtgctcctttcttcgatgaatacggcaaaaaaatcaatattgtcatgtttgatgccgaacacgaacggataaaagagattctggaaaagaatgcctccacacgcgattataaaataattcccgtaaatgaagacaatctgacccatgtattccgtattacagaggcactggagcgcaaagaatatgtctgctttcaaggtgaccgctatctgaataaagagaaattactcagcagtccgttcatgggaaaagaagccgaatttccgatgggtcctttcctgctggcttccaaaatgagagtacctgtcgtattctattttgccatgcgtgaagcgaaaaaaaactatcgtttccatttctttattgccgaggcggtggtacataccaaagagaagcgggccgaacaagcattattggagcaatatacacaaacgctggaaaaaatcgtccggcagtatccggaacaatggttcaattactacccgttctgggcataaatacaaatctggattatgatgcataaaagatatacaaaagagcaattgacagctgtagaggcacaaagactggcgcaagagatcgctttcggtcccgtggtattccaagtctcacgtctgatgttgaaattcggaatattccaattgctggccgacaaacggaaaggatacacgctgcaagaaatcagtgtgcagaccggactgacacgctatgcagcacaagtattactggaagcatcgctgaccatcggaaccatcctgttggaagaagaccgctatgtactggccaaggcaggctggtttctgctgaatgataaaatggcacgtgtcaatatggaattcaatcacgatgtgaactatcaaggacttttctatctggaagaggctcttttaaatggtcagccggaaggattgaaagtattcggcggatggcctaccatttacgaaggactttcccaactgccggaacaggtacagaaaagctggtttggctttgaccatttctactcggacaactcgttcagccaggcattagaaattgtatttcttcactcaccgaaacgactgctcgatattggtggaaacaccggcagatgggcaacccgatgcgtccaatataatcaagaagtagaagtaaccattgtggatttgcctcaacaactggaaatgatgagaaaacaaactgccgacgtgcccggtgcagaacgcatccatggccacggcgccaatctgctggatcggaccgtgccctttccttcaggctttgacaccgtatggatgagccagtttctggactgcttttcggaagaggaagcaaccagtattctaagtcgtgtggcacagtccgccagcaaagacagtaaagtctacatcatggaaacgctgtgggaccggcagccatacgaaacgggctcttactgcctgactcaaatcagcctttacttcacagccatggccaacggcaacagcaagatgttccattcggatgacctgatccgctgtattaaaaatgccggactggaagtggaagagattcatgataacataggactgggacacagtatcctgcaatgcagactgaaatgaacagaaaagaaatcatttgtcggggagacgaactgttccggctgattccacaacgtccgcccatggtcatgatagaccgtttctatgggatagaagaaaatacatcctggtcagggctgaccgtcacccccgataatctgttctgccgggacggcgtattacaggaaacaggaatcatagaacacatcgcccaatcagcagcggcacgggtaggatatatctatatgctgcgagaagagcctgtaccactaggctttatcggctctgtagaaaaaatgaaaatattccgtcttccttctgccggagcagaattatataccggaataaccattgtgcaggaaatattcgatatcacactgattaccgccgaggtgaaagaaaacgatgaacttctggccgaatgccggatgaaaatatatctgaaaaaagaatgaaacgaaaaacaagtccacagcaggcagcactgacagaccggaccaccatcaaggtccgcttcagtgaaatagattccatgcagatagtatggcatggtgaatatgtgcgttatttcgaagatggacgtgaagctttcggaaagcgatatggcttggactatatgagcatctaccgggaaggctatgtagttcctatcgtagacctgagctgccagttcaaacagtcgctgtcattcggtgaggaagccattgtcgagacacggtatattcatagtgatgctgccaaaatcctttttgaatacaccatctaccgggcatcagaccaaaacattgtggcaacaggaaccactacacaggtattcctgaatacaaatagagaactggaattggttaatcctgccttttacatagagtggaaaaagaaatggaacatcatctgactacctatatcacccatgataccctgatcagcgcgctgggtttcagcacacaggaaaatttggaagccatccgggcctaccacagtggcatcaccctgcagacggacaaacggattgcagacactcccctattggcagctactatctcgcaagagagattgcaacaacaggcagaaacagcaggaataagcgcatatacccggatggaacaactgtttatattgaccatcaacgacctcatccgtcagtccggacaaactttggaggataaaacctgcggactcatcctctctaccaccaaagggaacatcgacttactgacccgtcatacggaacatcccgatgaagcggtctttctttggaaaatggcagaaaacattgccggttatttccatgctgaggaacgggtacatgtcatctccaacgcctgcatatcaggagtgtcagcccttgtaacaggaaaacgcatgatagagaacggcatctaccgcaaagtaattgtagcgggaggtgaccttctctctcatttcatcaccagtggtttcctgtctttccggtccctcagctcccgtccatgccgtccgtatgacagcaaccgtgacggactgaacttgggagaagcttgcggagccgtattactaagtacggaaaagacgccaaacagcatcattctttccggaggagccataagtaatgacgccaaccatatctccggcccttcccgtacaggagacggactctttttcgctatccgccaagccatgcaggaggcaggaacagccctccaaaacatcagctttgtcaatgcccatggcacggccaccgtatacaatgacgaaatggaatccaaagccctcacgctggctcatctggaacaagttcccacacatagcttaaaaccctatttcgggcataccttgggagcatcgggaatcattgaaagcattgtctgtatgcacgaactgaaacaaggcatcctgttcggcactccgggttacgaaacaccgggtgtgcctatgcctataccggtctatgcaactcaccaacacattccgatgaaacattgtgtaaaaaccgcttcgggattcggtgggtgtaacgcagccattgtcttatctttaccggaatatgctccgttcaaggatgaggacaacaccttgcccgaaatccgatgtacacgggaggttcgtattgaaaacagttctgtcttcataaacaacgaacttatttttcattctgaagaaccggatttcggcatatttatacgtgatacctataaaaaatcaggcggaaacaatatgaaattctataaaatggatgacctttgcaaactgggatatgttgccgccgaatacttactgaaagacaagacattcgccccactggaaatggggatgttacttgccaacgccacttcatccctacatacggatatcagacaccagcaactgatagaccaggacggagaccgggcagccagtccggctgtatttgtttacacactacccaatgtagtgtccggcgagatttgcatccgccacaagatacaaggggaaaacacctttttcataactgaagcctatcagccggagaaactggaaagatacgcacgtatagtcatgcaaaaagggaaactgaactattgtatcatcggatggtgtgaattattgaaaaacacctataaagcagtatttaaactgattgaaaaacaataaagaatatggaagaattgattgagaaattgaaagttgaattaatagaagcattgaatctggaagaaatcactccggaggacattgatagtgaagcacctttattcggagacgacggattgggtcttgactcgattgacgcattagagattatcctgattctggaaaggaattatggcattaaaatagagaatcctgccaaaggaaaagaaatattctattcggtgcgtaccctggcagactacatcaccgcccatcagaaatgaggaagatctatgtcaccggtctgggagtgatttcgggcataggacaaggagtaaaagaaaatctggactccttaaaatccggaaaacacggtatggggaaaatcacccttttccccaccgtgcttgacgtacccgtgtccgaagtgaaacaaagcaatgaagaattaaagcaaatcctgttccttccatccggcaaaacgtattcacgtacagccctgctaggcttgttggcagctcaagaggcagcccgtgatgcggaactcgatttcgcttctccccgtatcggactcatttcttccacttccatcggaggaatggatgcaagcgagcggttttatgcctctttccgggaggataaccgaaaaggaagattacgtgatattatctcccatgactgtggagccagtaccgaaatgatagccgcttatttaggagtgaaaggaatggtgaccaccctcagcaccgcctgttcttcggctgcaaatgccattatgttaggggcacgcctgattcgacacggttatctggacaccgtcctcgtaggtggaacggatgccttatgccgtttcacgctcaacggtttcaattcattgatgatactggacaaagagcactgccgtcctttcgaccgcacacgtgccggattaaacctcggagaaggagccggataccttgttcttcaatcggagaaatcccttacaaaggctccttattgtgaactcagcggttacgccaatgccaacgaagcctaccatcagacaggaagttcccccgatggaaacgggcctttcctttccatgagtcaggccatagcctctgccggactgacagccggagccatagactatatcaatgtacatggcacaggtactcccagtaacgacgcttccgaagggaaagccatccggcgtatcttcgatacccgtattccacctttcagttcggtcaaggctttcatcggtcacaccctgggagcctcggaaggaatagaagccgtatattccgtactctccatccgtcacggactgatttaccctaatctgaactttcatctgtccgatgaagaaagcggtctcattcctgaaacgattttccggtcgggacttcccatacggcatgtattatccaactccttcggattcggcggaaacaactcatctctcgtattttccactctaaacagatagcgtatgcgcccagtatatatcaatcgtatcgcctctattcatgcagagagcagcaatgaaaagccttatttctccgcacaggaacctgattataaagaaatgatcaccaacgccaatctgcggaggcgcatgagccgcatgatcaagatgggagtagcttgcggactggaatgtctgaaagatatatcgccggaaaaggtagatgccattatcaccgctacgggactgggttgtctggctgatacggaaaagtttatgaacgccttgatggataaccgggaacagatgctcaatcccaccgctttcattcagtccacctttaatacgatcggtgcacagatagctttgctactcaaaatacatgcttataatgtgacgtatgtacaccgtggtttaagttttgaaagtgctctgacagatggcatcatgagtattgccgaaggcaaacagcatgtactggcaggtgctatggatgaaataacccctaccagctacatcatccagcagcgtttaggactgttgaaaggaacgacagccggtgagggagcacaatttttcctgttaagcgcacaaaaagaggaacagacttttgctgaactgaaaggggtggacacttttatcacccggatgagtgctccggaaatcagtaacaggatgcatcattttctaaaatctcacgagcttgcacccgaagacattgactggtttatcagtggcaagaacgggcaggaagcaacagatgccgtttatacagagctggaacacagtctgtttcctcatgccctgcatagcagctttaaagagcaatgcggagaatatcagactgcctcatcctatgctctctggatggcggcaaaagccttgaaagaagaagcttcatcccgttacgcattgatttataaccaatatcaaggtatcaatcattcaatcatcttaatcaagcgatgcacatcttaatttctgtagtcatcatagtaagcgtcatggcctattaaaaagatgcttttaagatactgaaaacaggaataatgcttaactttatccctcataaaataaaagtagtaaaaataatgaagaaaataactgttacgaatattgatatatccatatctgtaagacctgataataatgattatatctgcctgacagacatggcacatttcaaagacagagaacgtactaactacattatacaaaactggatgcgtctacgtagtacgattgattttcttgggttatgggaaaaactaaataatccaaattttaaaggcatcgaattcgatgcttttaaaatggagagtggaacaaacagtttcaccctaacccccaaacaatggatagaaaaaactaaagcaatagggattatatccaagcccggacgatatgggggaacttttgcccataaagacatagcttttgaattcgggacctggctcagccctgaatttaaactatatctcatcaaagaataccaaagacttaaagaagcagaatcacaccctttattaagtgaatggaacgtaaaaagaatacttagtaaagtaaattattccatacatacggatgcaatcaaagactttattatacctaaagtagaagatttcaatcaaaaacttgtttatgccgatgaagctgatttgttaaatctcgcattatggggatgtaccgcaagacaatggcgtgaagcaaatccacaatacgcagataagaatatcaatatcagagatgtagcaagcataaatgaattagtcgtattatcgaatatggaatccttcaatgcagagttaatcaagcgtaaggtagacaagtctaaaaggtttactcatcttcggcagatggccaaagagcaattagcacacttgaatacgattgataccgaaaagaagttcagaatactgacggataatgacaagcaattagaataatctctacaagatcatttattaaagtatcactcagtcatcttaatcaagcgatgcacatcttaatttctgtagtcatcatagtaagcgtcatggccttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcaagcgatgcacatcttaatttctgtagtcatcatagtaagcgtcatggcctttttcttttacgcttcttacagcatccgtgcctgtatttacatgcgcatcttctgtcgtaaaaagaccgaagagaaaatcatagccatcacttttgatgacgggcccgatccgatacagactccaaaagtgctgaaagtgttaagagaaaaacacataccagcctgctttttttgcatcggaaacaagataaaaggcaatgaagaactgctccggcaaattataaaagaaggacattgtatcgggaatcattccttctcccattccggctatttccctctctataccttcaaacggatgtgccatgatttaattacctgccagcaagaattggaaaaagtaaccgggcaaccggtccaatggttccggccgcctttcggagtgaccaatcctaccctagcccaagcagtgcgcaggctgggatactttcccatcggctggaacatccgcacactggacactcagcaacccactcctgaaaaaataataaaacgcatcaagaaacggctcgttccgggctccatccttctgctgcatgaccggatgcccgatagtgacaggctgctggtacaagttctggactttataaaaaaagaggggtatacggtggtagcattagacaggttgataaaggacatgacaaaataaatttcttctatattttcaacagcaacatcaccaagttccagaaacgagccccggttcacccttcatgatcaaaccgataaaaagataacttcgtcttacgtaaaacataaaattcctccgccacttcattccactcattaccaacaacttgccgtgtaaaaaagtctgtaatacccccaaaccggtatgtaagcgatggagtggaacattcacccgttatttgcaagagaagcgtagatatcagattaaatctgacaggatatgctgtactttcgttcaacttaataggatgtcagtgtgtaaacttccgatatatactgttacttcaccagtgtgaaacggtggtttcacactggtgacaacagctcttcacacaggtgaaaacccatcttcacctaagtgaaaatcatatcctaccgttctccttacaagaattccaacagaccttcatcctgcataatgacgctttctgccaaactgactccgacagggaaaacggataaaccgtttcgagggtacacaggaggattcgtcactataaattattgattaacaacaacatgcggtgatggaacaaaaaagtattgcaacgcagaaatataacttttttattcattataattgcccatgtgaacgattgtagaaacaggtaaaaatcgtaaataagcgataaaggtatgaatggtttcccaaaatatactatctttgcttcccattacaaacggataaacctctataaagtatgacctacatgaaaatacttttgctcttgatgttctgtacagtcctgccgatgcaagcccaacagatgaagaaacttactgatttgaaagattttgaagcccgtctgctgcaagaggctaaaaatatagagtccatcgaaagtaatttcactcagataaaatatctggatgtattcgatgagaaaataacctcgaaaggaaagttttattataaaaagagcaataagatatgcatggactacgcacagcccatgaactaccttatcgtgatcaacaacaaccaactgaaaatagtatcggacggaaagaaaagcatcatggaccttcactccaacaagatgatgaaccagatgcaggatatgcttaccgcctgcatggtgggcgacctgtccaacatgtcgcccggctatgttttagaatattttgaagacgcccattactatctcattcaaatcaagcccgtcagcaaagcggtacaggcatatatcaaccagattcaaatttatttagacaaaaaagacatgtctgtccacaaactacgtttatcggaaaccgcaaccaactataccgaatacgaattctccaacaagaaattcaattctttgaaagatgagacaaagtttacgatacgctagctggctgctgttgctgtttattctgctctcttgctcacaccgggtgacgggggaagctacggcacttcctcccatcctgcaggcagaagcacagtcgcaaaagtacaacctgcaactggatttcatgaaacatcatttcagcggaatgctcattgtccgccaaatgcccaataacgaaatccgtatcctgggatccacctactttggcctcagcctttttgacttctccctgcactgcgacaccttcatagtgaacagttgcattgacccgatgaggaagaaaaagatgctgaaaatactggaaactgatttcaaaaatctatttctaaataatgaaaaagcacatattaaaaagaaaagtagtacttttgaacaaagaatcagtggcaaaggatttggaaagacgatattcaccttgtccggcttcgtaaacggacaggcagggaaagtacaaatcaagcatccactgatacggttaagaattcaattggacaaactgaacataaacaacccttgagatgctgctggagaacttttataaaatcattcatagaaaggaaagagaagatgggaaacgggaaatagagatagaactgaatcccggccatgctctctatcagggtcattttcccggacagccggtggttccgggcgtctgtaccttacagatgataaaagaaagtgccgaacaaatagtcaaccggcctttgcagtatgtacagattgcttcttccaaattcctgtctgccatcaacccgctggaaacacggctgctgcaactatttatccgagtggaagagacggaagagcaccttttcaagttacaggcagagggcatttgtaatggaaaagaatttatcaagttgaaagcgacactgatgacaaatagtaaaaagactcattctttgtgataaatatcggatatatttatctccgacatacttcgtcaaaatacttgtaagtatcagaaaagcagattcttctgttaaacattcataatagcaagaacaataagtccatttatacttgtcagcatctatcaaatttcttatatttagacaatctaaatctgatacttatgaagaaaggttggcagcagataatgttataccttatagttctcacaagctatgggtgtttttctgatgaagacaaatgtatccgtcagttggtgcaggaggtaggtatctgccttccaaacgcttcagactcatgttttctaattattattcccggcaacggttgtggcagttgcattcaggaggcaatggacaatatcagagaaacaacagacacgatatatgtctttatgtgtgatacggaaaaagatttcttcttgctgagcggcggcaaaaaatcaacggatttcagcaatctttacttagataaagacaaagtatcaatcagactgaaaatggtaaccacttttccaatggtatacttcttaaaagacgggaaatatgtagaacgttggccttatcaaagacttacggcagagagcaggaaacgaatgaccactctgactgctgataagcagtatatcgactggggaagtttcagacaagcggaaatacaggaagagaaagtgatattgaccaatatcggaacagatactttatacatcaatgccatagaatcatcttgtgaatgtaccactgtacaatgggcggattctcctgttccaaccggcgagtgtactactctgacgattcattttcgagcggaagaagagggggaatttgaaaggtttatccatgttcattgcaatgtaccggagtctccgatagaaatttccgtaaaaggaaaagtacaataaatctaaccattaaaaacgaatgcctatgaaaacaagattcacaatgattgtggctgttattgcaacatttgcaataagcttgaacctccactcttctaatgaagaagtggtgtttggagcacctgccatgcaaatgccacgagggggagctttacgctgtgcttacaaccaagatgttaatgattgcatatggacatacaatggaaccgtttgtattgacctaccaggcgaatgtggtactggagcaatcggcagacctggtgaaggctctcaaggaggtggaaattatggtgcccctaccaattaacaacaaacaatttatgtggtcggttttttactggccacataaattacatacatcataaaaccgaaaagattatgaatcgaacactcctttttatatcattcttttttatactaacccttgtatcttgccagccctcaaagaacaacaatggaaaaagacagaacgaagtagaactggtagcagaaaaacagctggtcttccctttagacgaacagacctattacttaagcaaatccatgttccaattcgaagaaaatggaaaagaatatcttcactttgagaatacacgaaaatcattatatgacattgtcatttttgatatagagaatcaacaaatagccaaacggatacctcttcacaagacaggtcccaacgggctgccgactgtatatggaagcagaccttcgcccgactctgaacaaatattgatttcgcagaataatataggtcggctcagcactataaataaccaaggagaggtactacgtaattatacagtcaaaacccctgaaggcagattcacaacattttttttctgtagttactataatgcacctgcctttgtcaaagactcttgcatatttttaaatcaaggtatattcaaaccaaacatgaagagagaagattggccccaaacccacatatttgcctcactaaatctaaaaaccggtaagtttgaatgggttccgatcttctatccacctatcttcaatgaggaatatgaaaacatagacggaggatacggattcagttatgattacaactacaaagagaaccgtttgatctgcggttttttcgggtatgacagcctgatggtcacagatgacttgaaacacatccgatggtataacgccaagagcagatatctgaaaagcatgaaacccaaacttggaaatgccatggctggaatcaattccatcatagaattttgtgaaacaccgaaatattggcatatcatgtatgacaaataccgagatgtgtattaccgatttgccgagatgccttacaaactggctcccaacgaaagcccctatgacgaacccaaaggaaaggaattctccgtcattgtactgaacgaggattttgaaatcatcggagaaacaaaattccccgggaagaaatatttctacaaaatgagctttgtgggaagggaaggactgtatatatccgaaaacaatctggaaaatccgcaattcgacgagaacaagttggtgtttacctgctttaaaattaaaaaagcaccttaagaagcaatgccacaagaaaacagtttgcaaccatgataaaaacgaaaatactatgaatcgagcatatctttttataacagcactttttgttctgattttcatgtcttgccagtccgcaaagaaaaacaacacagaaagacagaacgaaatagaactgatagcagaaaaacagctagtcttccctttagacgaacagacctattacttaagcaaatccatgttccaattcgaagaaaatggaaaagaataccttcactttgagaatacacgaaaatcattatataacattgtcatttttgatatagagaatcggcaaatagccaaacagatacctcttcacaaaacaggtcccaacgggctaccggcagtattcggcagtagaccttcgcctggggcccagtatatattagttgcacagaacaatatcagcagaatcagttccatcaatgataagggagaggtaatacgaaactataatttccaaactccggaaagccaatttacctctttacatttaggaagctattacaacacacctggttttgtcaaagattcatgcttatttctgaaaataggtattcccaagcccgacatgaagagagaagactggcctaaaacccacatgtttgcctcactggatctgagaacaggaaaagttaaatgggttccaattttctatccacctatctttaaagaggaatatgaaaacatagacggaggatacggattcagttatgattacaactacaaagagaaccgtttgatctgcggttttttcgggtatgacagcctgatggtcacagatgacttgaaacacatccgatggtataacgccaagagcagatatctgaaaagcatgagacccaaacttggaaatgccatggctggaatcaattccatcatagaattttgtgaaacaccgaaatattggcatatcatgtatgacaaataccgcaatgtgtactaccgttttgctgaaatgccttacaaactggctcccaacgaaagcccctatgacgaacccaaaggaaaggagttctccgtcattgtactgaacaaggattttgaaatcattggagaaacgagattccccggaaagaaatatttctataaaatgagttttgtaggaagggaaggactgtatatatccgagaacaatctggaaaatccgcaattcgacgaaaacaagttggtgttcacctgctttaaaattaaaaaagcaccttaacaagcaatgccacaagaaaacagtttgcaaccatcataaaaacgaaaatactatgaatcgagcatatctttttataacagcactttttgttctgattttcatgtcttgccagtccgcaaagaaaaacaacacagaaagacagaacgaagtagaactggtagcggaaaaacagctggtcttccctttagacgaacagacctattacttaagcaaatccatgttccaattcgaagaaaatggaaaagaataccttcactttgagaatacacaaaaatcattatatgacattgtcatttttgatatagagaatcggcaaatagccaaacggatacccctaagcaaaacaggtcccaacgggttgccggctgtatctggaagcagaccttcgcccgactctgaacaaatattgatttcgcagaataatataggtcggctcagtactataaataaccaaggagaggtcgtacgtaattatccagtcgaaagtcccgaaggcagattcacagcatttttcttctgtagttattataatacacccgcctttgtcaaagactcctgtatatttttaaatcaagatatactcaaaccaaacatgaagcgagaagattggccccaaacccacatgtttgcctcactaaatctaaaaactggaaaatttaaatgggttcctatcttctatccacccatctttaaagaggaatatgacaatatcgcaggaggatacggttttagttatgattacaactacaaagaaaaccgtttggtctgcggatttttcggatatgacagcctgatggttacagatgacttgaaacacatccgatggtataacgccaagagcagatatctgaaaagcatgaaacccaaactgggaaattctatggaaggcatcaatgccattataaaactcagagaaacaccgaaatattggcatatcatgtatgacaaataccgcaatgtgtactaccgttttgccgagatgccttacaaactggctcccaatgaaagcccctatgacgaacccaaaggaaaggagttctccgtcattgtactgaacgcggattttgaaatcattggagaaacgagattccccggaaagaaatatttctataaaatgagctttgtgggaaaggaaggactgtatatatccgaaaacaatctggaaaatccgcaatttgacgagaacaagttggtgtttacctgctttaaaattaaaaaagcatctccaaataaataattaacgccagaatgcccgcatccgaaaatatactatctttgtcacccattagaaaccacataaattcagatacgaaagtattcatcccaaacgtatctgaatagtttgactgaaaaacaagatgaatacaaacacaacatcggtttggcggaagaaattaaaggaactggagattgtcgtcgttattcccacctacaacaatgggaaaacactggcggcagtcattgaggaggtatacaggtatgcagacgatatcattgtcatcaatgacggctctacggatgatacagccaacattctggaacaatatccggctatccgcactattacccatccagtgaataaaggaaaaggaaccgctttgaagcatggtctttcccaagcaaaaaaagagggtttccgctatgccatcaccatagattcggacggacagcatttcgcttccgatattccctgttttatcgaagccattgagaaagagcccgacacgctgctggtaggtgcccgaaacttggcctccgacaatatgccgggcaagaataccttcgccaataaattctctaatttctggttcagactggaaaccgggctgaaactggaagatacacagtcgggataccgtctctaccctctccgcaaaatggatgtgcaaagctgctggtacaccgccaaatatgaatttgagttggaagccatcgtcttcgccgcatggggagatgtagtggtgaagaacattcctatccatgtgtactatcccccgcaagcggaacgggtatcccatttccgtcccttccgggattttacccgtatcagtgtgctgaacacggtgctggtgctgattacctgcctttggattattccccgtaacctgctccgcaaactgtcatggagcaactgcaagcgattctttaccgacaatgtgctgaatacacgggaatccaacctgaagattgtactcgccatcatgctgggtatttttatgggtattgttccgttatggggttatcagatgctgatcaccctctttcttgcgcatctgttcagactgaataaagtgattgcccttgtcgccgccaatatcagtattccacccatgattcccctattgctgtatggcagttaccggacaggctgcatggtactgggtaatcctcccgatttgcacctcggagacctttctcttgaaaatgtcaaatcagttttagagcaatatttaataggaagcattatctttgcaatggcttgcagtctgctgtcgggagtaatctccaccgcgttgctggccatatgtaggagaaaaaacggatatgactaaattctttgttggattatataactattttgaaaggcataaagtcttgttttacctgtccctcagcgtatgcattctctttatggccctttttgccgcccaagtcagattcgaggaaaacgtaaccagtttctttccggataccaaggactcccaaaactccatcaacgtatttgaaaatctgaagataaaggataagattataatcatgctgtccggcaaggacggcatggcggatgcggattccttgattgaagctgccgagacaataaaacaggatttacaacaacaagcggaaggaaccctgattaaagagatcttctcaaaagtcgacgaaaacctgatcaacagtgccggagattttgtttacgacaatctacccttgttcctttccgacgaggactaccaacggctggataccttgcttaccgacgaaaacatagccgccctgatgcagaaaaactattccaacctgatatctccggcaggattcgccttgaaggactaccttatgcgagacccgttggggctaggcagccagacgctgaaacacctgcaagacttccagttggaatccaattacgaactgattaatgaacatattttctcacaggacggctccaccctgctgatgttcatcactccggtattcaacaccggaagcacgggcaaaaatgacaaactcatccggctgattgaagatgaactgcaaaaagcggaaaaggaacacccccaattagttgccgaatatttcggaggtccttccgtaggagtgtacaatgcgcgacagataaagaaagatacgcttgtcacttcttccatcgcactgattatcattattgtcttcatatctctggtattcaagcataagaaatccattccgcttatcatcaccccggtgctgttcggagctctattcgccttatgcctcatctactttatcaaaggcggcatttcagccattgccgtaggtgcgggttccgccgtaatgggcattgccttaagctactccatacacatgctggcgcatcagaatcatgtatcatcggtgcaacaattaatcagagaaatcgcctatccgcttaccgtaggcagttttactaccatcggcgcctttttcggcctcctctttaccagttctaatctgttacgggattttggtctgttcgcctcgcttgccttgataggaaccacgctgttttgcctggtctatctgccgcatttcctgaaagggcaggcgcatgtaaaacaaggggcggtgctacgctttatcgagaaactgaacgcttatccatacgaaaagaacaaaggactggtaggtttcatccttattctgaccttagtatgtatcttcacttcgcagaacgtgcgtttcaacgaggatatgatgagtctgaactatgagcctgcccacttgaaacaagcggaaaacaagctgaccgaactctttgacaagcaagaaaagaccgttctctttgtcagtacaggcaaagatatgggagatgccacgggacaatacgccgaaacaaaccggctgctctcccaattgaaagaagagggaaaaataaaagattatgcctctgccggacagtttctgataccggaagaggtgcaggaagtacggttgaaacaatggcacaactactggactccggaaaagaaagcctggctacgcaaaaccattcggacagaagctgcccgctatcatttccgtgaacatgcattcgagccgtttttccaatggctcgaccgtccgttccagcctttggactaccaaaatgaaatcacgacccagcttctgaacgaatggcagacttccgctgattccctgaccatgctgattactcaggtacggatgaacgaggccgacaaggaagcggtgtacccccttttccaacaaaaagagaaggtggttatctttgaccgtggttatttcgccaaccaatgggtatctgctgtcaatcaggatttttatctgattctttatatctcttctttcctgattttctttgccctatggatttcctacgggcgcatagaactgactctgatgagtttcctgccgatgctggtcagctggattatcattgtgggattaatgggcatactgggtattgagttcaatatcatcaacatcattctgtccacttttatttttggaatcggggatgatttcagcattttcattatggacggattgcagaataaataccgcacaggacggcagttgctgaactcgcacaagacagccatcttcttctccgctttcaccaccgtgataggtatgggcacattggtcttcgcacgccatccggcattacagtccatttccctcatctccattttgggaatgatcgccgtcgtactggtggcctacacgctgcaacccatccttttccgattcttcatcacagcccctgcttccaaagggttgcctccttatacattgacaggactggcaagaaccggctgcttgttcctgctgttctttatcggatgcctgttcctacgcttgctgatagctgtcatgaccttgcttcctatccgcaaagcctataagaaacaagtactttgccaactgatacatgtcacctgcaaaggcctgatccatatagccacatttgtacataaagaaaagataaaccggacgggagaaacgtttaaaaagcctgccatcctgatagccaatcatcagtctttcatcgacatactggtattgctggcactgactcccaaactggtcatgattaccaatcactgggtatggcactctcctttcttcggagccattatccgctatgccgatttctattacgtaggagacggttatgagctttacgtggaacggatgcgccaaaaagtgaaggaaggatattccatcgccatcttccccgaagggacacgtacctacgatggaaggatgaagcgtttccataaaggagcattctatctgtcggaaaaactgcaactggatattattccggtcatcctttacggcaactgtaaaatcatagcgaaagcacagccgttcaatgtacggaaaggcatcatgctgacagagattctaccgcgtatcccagccaacgatgctacgtacggaaccacttatcaggaacgtaccaaaaacatctccgcgcggatgaaaaaagaatatgcccgtatctgtcgggaacaaagcacaacggacaatcccgtcttctacgaaaatctggtacagaactatatctataaaggaccggtggaggaatggtacatacgcatcaaggtgaaaatggaagataactacaggctattcaaccaactggttcctgtcaaaggacagattacagatatcggttgcggattcggaccgctttgctatatgctttcccagctttccgaggaacgggagattacagggattgattatgatgaggacaaaatagcagtggcgcaacagggttggctccgcactccccacctgcaatttgtatgcgccgacgcattggaatatcctttaccggaaagtgacgtattcatactgaatgacatgcttcattatatgagttatgagcatcagcggactttattactcagatgcgtggaacggttgcgtccgggagggaagctgattgtgcgggacggcaatgccgccaatacaggaaaacaccgtctgacccgtttcaccgaactgctgtctaccggcattttcaactttaacaaaacgacagaacaactgtgtttcacatccgaagaacaaataagtagtatcgcacaagcatgtgggatgcagctggaaattttacctaacgacagatatacttcgaatacaatttatatcttccagaaaaacaaaccggagcatgagtaagtacgatatcatcatcataggcagcggactgggcggtctggaatgcggagccatcttaagcaaagagggctaccacgtctgtgtgctggaaaaaaacgaattgtttggcggctgcttccaaacttaccaacgcggtgggcaccggatggataccggcattcactatatcggtagtctggatgaagggcaaattatgaaccagtatttccgttatttcggaatcatggacaagttatccatcaaacggatggatgaagaagtgttcgaccggatttattataaagacgctatctatgattatgccatgggatatgaacgttttatggaaactctgtgctgctcattccctcatgaacgggggaacttgaaaaaatatgtggcatccatccggtcggtgggaaacctgatcagcatagatcacctgagaaaaggccgcctgtcccaagaaggcatggatttctttgccacctcagcagccgggatgatagcatccgttaccacgaacagggatttacagaatgtacttgccgcaacctccctgctttatggcgggatcaaaaataaatctaccttttatgagcacgccatgattaacaactcttatatggagagcgcctatcgtttcacggaaggaagtatgcaagtcagtctggaattaatccatatcatacgtgccaacggcggcacggtactgaaccggaaagaagtgacccgtatccttgtcaaggatgaagccatacaaggagtagaagtgaaccatgaagaggtactggaaagtacctgcgtcatatccaacctgcatccgcaactcaccttatccctgctggataagaaccattccatcaaaccggcttttgtgtctcgcatcaagtcattggaaaacagctacgggatattcacgctcaatctgatgatgaaaaaagacagttgcccttatcaaaactataatatatacctgcacggcaatgaggatgtatggtatgacaaagaggcacacaaaggaaatatccccagttgtatgatttccatgcaagtaccccacggaaacagcagattcacagatgtggtttccatactgactcccatgtatatggatgaggtcagcacatggacggatacgactcccgagcaccgtggagaggcataccgccagtttaaagaaaaaaagacggaacagatcttgcagttcctgagccggttcgggtttcactggagtcattgtattgaaaaggttcatactacgactccgttgagctatcgggactataccggaaccatagatggttcggcatacggcattgtcaagaattaccaatatccgcaaatcagttttgtgtctacacgcaccaaactgaagaatctgttcctcacagggcagaatctgaatgtacacggtgccttgggcgtgacgctgacagccatgctcacttgttcggaatttgtaggtcaggaatatttagcaaaaaaagtaggcaatgcataagatttggaagaaaacaataaaatacggggggatagccctgttgattctgatagcgacgatcatgataggcatgagttatctctatctatctgccgatatgatgactccgcaatttgcgtctacccctgaaacggatcgtgtgatacggaaagacagcctccggcagtatggcggaaactacctgcggcacagtgagagcggactttgggagctgaaagtaagcggacctgcctacgaaaggggcgaagccataggcaagctgacttccgatttgctttattttcaagaaaaagtatttgtggaccagataaaagagatagttccctctgaaagttatcttaaattcctccgcttcttcattgtccttttcaaccggaatctgggaaagaatgtgccggaagagtttcgggatgagatttatggcatctcactctcctgtacccacgaatatgattttatcggcactccttacgaacgtcaattgaattaccactccgcccacgacttgggacatgccatgcaggactatatgctggtaggatgcagttcctttgcctgttggggtgaaaacagcgctgactcctcccttatcatcggccgtaatttcgatttctacatgggcgatgactttgcacataacaaactcgtttcattttaccagcccgaaaacggatatcgtttcgcatccgtgggatgggccggaatgaccggtgtcctttccggcatgaatgaaacggggctgactgtcaccatcaatgccgccaaatcggatctgcctgccgcatccgccacccctatttccattctgaccagggaaatattgcaatatgcttctaccattgaggaagcatacgctatcgcccggaaacgaaaaacatttgtctcggaagccatattagtcggttcggctcaagatggcaaagcggcgattatagagaaatcaccggagaaaatagctcttttcacgggaaacggacaacagattatctgtaccaaccattatcagtcggaaacattcagccatgacaaacgcaaccgggaaaacatagaaacttcggacagtccctaccgctttgcccgtttgcaggagctgctgaaagcaaacatccccatagatgcttcgaaagccgcctctatcctccgcaaccggaaaggagtgggaggagcggaactgggacttgccaatgagatggctatcaatcaatttatcgctcatcattccgttattttccaaccggagaaaaagctgatgtgggtatccacctctccctggcaatgcggtaagtacgtggcatacgacctgaacaggattttcagtgattccatcgatttcaaccatgaaatctataccggagacctgaccctgcctgcggactccttcctgcaacaacaggaataccaacaactgatggcttacaaaagattggctcctgtactacggaaacagattaaaaagaaagaacggctggacgaacaaacactgcatgccttccaacatgccaaccctcatttcttttatgtgtacgagttactgggagattattaccatgccactggacagcaggacaaagccctgcgcaattggaagaaagccctcttgcttcctatccccaagcgaagtgaatcagaacgtatagaacataaaataaacaactaagatgaaaaagaacccggaaatacaattccgctcccctgaggaaatcaaagcctatcaggaaagccggctggctgaggaactgctttatttgcagaatcattcacgattctaccaacgtctgttccaagcacatcatatcgatatacaacagataaaaaccatagaaagcttgcaacagatacctgtcacaaccaagacggacttgcaacttcataatgaagattttatctgcgtgagccgcgatgaaattattgactatgtcaccacttcgggaaccttgggcgaccccgtcactttcgtattaacttccgaggaccttgaccggctggcctacaacgaatatctgtccttcaccaccaccggatgcagcagacaagatatactacagctgatgaccaccatcgacagacgtttcatggcaggcctcgcctactatatgggagcccgtgagctgggcatgggagtagcccgcgtgggaaatggcattccagaactgcaatgggacactatccggcgcatccatcccacgtgtggcatggtagttccttctttcctcatcaaactcattgaatttgctgaaaagaatcatattgattaccatcactgctccatgcagaaatgcgtatgcataggcgaagcactccgcaatcccgatttcaccctgaacacactgggtaaacggatacacgagaaatgggattccctgcaactttactccacctacgcatctaccgaaatgcaatcctcgtttaccgaatgtaatgaatttcacggtggccacctccagccggaactgattatcgtagagtttctggatgataacaaccagcctgtaaaagaaggggaagcaggcgaagtgaccatcacgactttgggagtaagaggaatgccgctgctccgtttcaagaccggagatatctgttaccattataccgaaccttgcgcctgtggacgtaacactatccgtctcagctccatactggggcgcaaaggacaaatgataaaatataaaggtacgaccctttacccacccgctttattcgatattctggataacatcccccatatcaagaattacattgtagaagtttataccaatgaactgggaacggatgaaatactgatccgcatcggaagtgaaaaccgcagtgaagcttttgctaaagaaatcaaggatttgttccgttccaaagtacgggtggctccgagtatcaattttgaatcggcagagtatatcgcgaaaatacaaatgccgcccatgagtcgaaaaatagttaaatttattgatttaagataatatttttctacctttggcagcaacaaaacaacacttaaaaaagaactaatatgaaacagttactcgttttattattccttgtaagcagcatggcttgcttcggacaaaacaaagacgcattgaaagatatctcttctgtgacattttatggcatagactttacccgtgccaaagtgtacggagcaaaagaaggccccatgcagttcaaatatacttttgatgacatcaacaagcttttcatcactgagccgaagaagtatgatattggcaaaagattgggtgtcaatgtagaagtgacctcattagaggcagtaaacgatgccaacaagaccatcaatcccgatgagatcatgacgaccaacagcggatacaccctggatgaaaaacagatagaagaagtcatcaagacacttcctattctctctcaagaagaaaaaacaggattgataatggttgccatgcttttaaacaaggcagatgcaagagcaacctatcaaattgtgttcttcaacacgaaaacccgtgagatactgtatagcgcaccgactaacggcaaagcacgcggtttcggactacgcaattattgggcaggttccgtacacagcgccatgaagaaactggactaacatataatcccggttcactgtagggatgaaatgttcccacccgatgccacaaaatcaatgtatccggatgagctcaattcactcctacagctaataaacctttttagtcaagcccctacggtggcagaatactaccaactatatcctgataaggataagtaaaccaaaaacaagagccttctccttcttctgactccacaccgatagttccacccatctgttccaccagactcttacaaatagacaagccaagtcccgtaccatgaacaaaactgttcagtttcacaaaacggtcaaatactgtttttatcttattccttgggattcccattcctgtatcacgaacataaaatcgcagatacccatctgtctgcctataatatcctaacgttatgctgcccgaaaaagtgaacttcaaagcgttattaatgaaattggaaatgacttgattcaaacgattcttgtctgcccatacatgacattcgggcaagcatttttcaaacaccagctccacaccagccggtactttcatgcgtaaagaacggataatctcaccgcaaagcaagttgacatccgtatcactcttgacaaattcaaaagctcccgactccatcttcgataaatcaagaatatctgaaataagctgaagaagcaactccgtattctcctgcacaatagccatgtactgcttgcggtccttcatatcttccgtttccgttaaaagactggaaaagcccactatagcattcagcggagtgcggatctcatgactcatattagccagaaaagcagatttcaaacgatccagttcttccgctttatcccttgccgctatcaacttccgctccgtttctttcagttcagttatgtcataattgacacaaaccatatcaatgatcccatcttccggacggaaatcgcgtaccattacattgactcttgtccacgtataagtgccatcttcacgtaatatacgtacatcacgcctcaaatggctggcttcccgtatcaatacctgatcaaagaagcgaagcatcatcctgcggtcatccggatgaaaatgagaatgcactttgataatctcattcaatggagttccttctttctcacctatattccgataccagctattcacagcatagccatcacatttcaaggcattaaaatgggcatatcctactttggcatagttacctatcaacgtgaaaaactcctcaaagtcctgtattttgctgtatgcatttgttgtttccgtattatcaatattaatcaacaatatatttatcagattacccaaagcatcataaagtggagcgaatttcgagattaaactaatagtaccggtacgagaagtagaataatagccatccaaacggtcgaaatcataattaaacgacatatcaataggtgctcctgctttcaacttatctttcagcccctgtggcagcaaaggattatcaaataaattcaatcctatcacatcctccttatgccggagaccgaagatttccatctccttctcattcaaatctgtcataaacccatccttatcatacaactcgataccagcaggaagatttttataaatattctgcaaataagctttttccagccgggcttcagattcagaacgtctcaattccatacaaatgctgataatattacccaaagacacaaaccattgataatcctcattacaccagttccgatgctcacgcaccatatccacccctatatacccccacactccgtcttttgagttcaaaggcaccaccatagtagatttcactccatattcctctaatctacgcttatccgccccggctgaatcaggaagcaaatttaatgtaaaaagaatgataggattaccagccaatatctgtcctgtccaccaagaggcataatcaatagaagattccgataataaaaccttgcgttcttttataccctccactgctatttcataggtacagacttccgtatgcaatttcctgtcaaattcaagaatataagtacgatctgcttgaaattggcgcaatacctcctttaaaatcttattgataaccaaggtaatatcatcagaatgtaaaaaatcaagcaatgacttggaaataccgttcaaacgagataataaagaattcaaccggtctactgtctgctcctgcatattcatccgttgccgggaaatacattgcaacatacccatgacgcggacatgaccttctttggtaatacgcttctcaccgaccttggtactaacccacatcatcccatatttggaatgtatcggaaaaacctgctcataaatctccatcatccggaaagagcgaaattcctccaaaatacgttcccgataattctcacaaatcagattagcgaaatctttagcagaaatcttattcccttctattcctaacaaatcggctacaaactcagaacaatagtagactccttcatcaaaatccacctcccaccatcctatgcgcgccattgatacaagctgctgcaaccttgcatcattttcttgaatcttccccatatttacactacccttgaattttatgtgccaagataatcattatatttcaatacgaagtgattaaacatgaaaaataaagaccaacaacaaataatcaaagcctgaaatctatttttaactctgttcatttgcaaatgaacagcaaactgtgtattttcgtaaaggaactacattacaaaccctgcaaattcatatgactatgaaacgtaatatcctattattaatgattttgacggtaatatccctaggagcatccggacaaaaatatacgatttatgtagatgacttcgacagtgaaatcaaaatacccaatagggcgatcaacctgattcgtctcgcatttatcgacggtatccgtaacaccaaccgtatcaatgtagtggacgccgtttcggctggcagtgatctcagtctgagtccgctggaagatgcacgccgcttcagagcagagtacctgttaaaaggaaacctgatacaaagagaagcaaccgatgacggaagctcccacagacgttaccacagccgtgagaacagttataaagagaaattcaccctgcgtcttgatttaatacggacaagtgacggagtaactatcagcacacgcaattatgaagaaacaggctcagcatccggtaaagatgccacccaatatagcgctttagagaattcattaatcaatgtgccatacgaaatgggactttttgttgaaaatcacttcaaagtatacggttcaatactgaaagtagtatctatcaaaagagacaaggcaaaaaccatttatatcaacctgggatatgatgatcctatcaaagaaggattacgctttgacgtagtggaagatggcatactggaagaacataatatagaaaccaaaatcggtgaaatacggattaccgaaatcatgggaccgaaaatctctttatgtaaagtgaacaaagggggtgaaactattcttactgcattaaatgaaggaaagaccttgaaacttatttccagacaggccaaactgttcgatgaataaaatatcattcataatgaatatacaacactacaaccgccgatccggcatctgccaaaacccggcggttttactatgtcaagacaaaccgctacttttctataatggaagttagaggatgacgattcccctttatctctctcagaaatgcttttgccgaaccaaaattcaaatataaatccaaacgcaccggcaaatggtttttatcatcagttacataaaaggttattacctctttttcttttccttttttatactctactaaggaaaaaaccaaacaacggtatttcacaccattctccgccttaaaattcttccggccacgataaatcaatgtttgctgctctactttagtacctgtagccatatcaaacaatattttatcgccgactttatagtcacttacatcaaatgaacgtgctctcatcaatatgctcagcatatcaaagatacactcatcactttggtccttcgatttcaccgtatcccgttccctcctcatacgacgctgatcggcaatgcattttccgtttttataactgaaccatacttcatccaccgtatagcggtcaccctcttcggcccctttacgaaaataaacgggttccagacgactgctggtaatacaagtcaatgtgtcacgcatcttaaaaaagaaatcgacttgtttgttactgacagagatcagattactacgaaaacaaggtttcccctgataggtaatagcctgcatgtccatttttgcctgtccggcagcaacccaaataaatttccagttgaacttcaagtcgtataccaactcttcgcctgcctggatggcttcgttttgtgccgcacattgcgctctagttgccattatagcaaaccaaccacacaataatattagaatagtttttttcatcggcctagctttctagctctttctttatttctatcttgtacctttttagtctcttccggtttttgtttctttatttcatccagcttttgcttgtctacaggaatggcattcacatcccaattctcttcaaattcaaagttggctttcatctcccataccttcgggaaataaaaaacttcttcgggctgaatcttcttatcataatctcctgtatcccatactccattatcattacggtcgttaaacaaacgtatataatatttcgtactcggattcaagaaataaaagtccgccgttccttccaccgtcaccggttgctgacgcaatacatttccactagcatccaataattcggcaatagcattgggagcagccccttttatattcaataaaatagtcccgtattcttccattttcttcaccttcaccgtttgctggactttatctgtatgcagcccatagattcctgtaaatgccaaagaatcaatagtcaactgatattcctgctccggttgccaatctgccaatatctgatattgccgtggcatcaacgagtctgccataaagaagaaaggagccggttgccacaaactgtccacttttacttccatatgaatggccgccgtgtctatacttgcgatcggttcttcaaaagatagatagatattcctatatatatcgaatgccgacggagcatcgacattcatagtcaagaatttagtcggttccaccctgatggtatctccctttttctccctctttttacgttccttctccttttcctcatttgcttttttctgcaatttttcccgttgctctcttgtcaatttattagccagataaatcgtatcggttttgggaaccaactggtttaacgtatccgtatataaataatccaactgaacctccagcgtatccatctgataaaccaacgaatccttaatccaataacaaattgagtcgtttcgtggagtcgtttctatgataaacgcatccttctcatcgaagttcaatcctttcaaggtaggtaacgtatcagccggcgcactgaaagataatacaaaatgattctctttatcacgctcgctcttggacagatattgacggtcgtttatccctttaaaagctctcagaataatatcatccggcaaaaagcgggtatagcccaccgttttgatggtgtcaatagtaaccgtatctttccacaatgtatcctgacgcatggccgcttccatagaagggacaataatagaatcgctaaaagcaatcatctctgtcttagagtcatataaataattctgattaccgtccatcaaaccaaaaatatgatatttgccgggtgctataccacgaatagtgaaacgcccacgactgtctgtacgagaaacacgatcgaacggttttttggcaaaagcactatcatccaaatcaacatgcaaccccaccatcatccctttaactggttccaagtcagcagccgccaacacagttccggaaacttccaatgtatcaatagtctcccctgtagaaaaagaaaaagaataattacccagtggattaccctcattattatctacaatagcatccgagaaatcaatggtataggtagtattgggtttcaatgaatccatgagattaaccaaaactcttctgccgcttgccttgatatcaggttgttccaattgaggaggagacaccaccactttttctgatgttttctccagtttgataaactcatcaaattcaatggctatcttcttgtccttgttgtttgttgcgtatggcttgggagaacttctgacgaacttgggcggttcctcatcataaggacctccatccggtgttcccatgcttgcacaggaatatactacgatcatcagcatcaacaaagcaggtaatttatgttttttccaattcatgttcttattggttcaagcttagcatttcttctatataatcacgcgtattgcttaatctcggcactttgtgttgtccgcctagtttgcctttttctttcagccaatcgtggaacagattaggtcttgccacgattatttccaacggctgcaaggtaatgtttttatggcgtttagcttcgtaatcggagttaatttgttgtaaagaagtgtcaagaacctggctaaaattctctaaagaatctggcataacggcaaattctatcagccactgatgacggcacttggcatatgcatccatgaaaacaggagcagcagaataatcaacaatctgtgcaccggtcgcctcacaggcttttgctaaccctttttccgcattatccaccatcaactcctcaccaaatgcattaataaagtgcttggtacgccctgttataacaaatttataggggtgtttgttggtaaacttcacagtatcaccaatcatataacgccacaatccgcaggaagtactgatgaccatcgcataatttttatttaattccacatctactaacggaacaatatgaggattttcagtaccgacatcttccatcggaatgaattcataaaatacaccatagtcaatcatcagtaacatggaaggatcactgaagtcattttgtaatccgaaaaaaccttcactggcattgtatgtttccatataatgcatcttgtcactacgaataagctgtttatattgttcgcgataaggagtaaaagcaacccccccatgaaagaaaacttccaaattaggccatacttccaccaaattatccgttcccttcacctccaaaatatgtttcaagacggccatcatccaggacggcactcctgaaaggttagttacattttgattcattgtggcacgagtaatcctttctactttttcctcaaaatcactcagcaacgctattttcttctcgggcacccgaatcagattgaccaacggattcacattttcaatcaatatagcagaaaggtctcctacaagactccgtttcacattatagtttggtgcatggctccctcctagaatcaggccttttccagagaagaaacgactctcaggattttgttgaagatatagtgccactgcatccataccacctgcataatgaatatcatgaaggccatccctgcttacgggaataaatttgctcttgtcattggtcgttcccgaagatttagcaaaccactgcacctctccacgccacaggatatctttttccccatggcgcatacgctctacgtatggcttgatttcttcgtaagtctgtataggtacacgctggaagtcttgatatctctttatgtctttatagccatatttcaatccccactccgtattggcagcatcattaatcagccggcaaaatactttatgttggagtgcctcagcctgagttgcatacaaggctgtcgctttttgtctgggcttgaatagcgtactaattagtctggtagaattcatttgtcttagtatacaattcgttatatcttgcaaaaatagcttatttctatattataatggctgataacattattttttttatagttttctacattacttttattttttgttatctttacggtcacttacaacttaacatcaaaggctatgaagataggaatattgacatcaggaggagactgtcccggaataaacgccacaattagaggagtttgcaaaacagcgataaatcattacggtatggaagtttatggaattcatagcggattccgggggttgctggacaatgacgtagaaccattgacagaaagatcattatcaggcttgttaaatttgggaggaacaatattaggtacttccagagaaaagccattcaagaaacgcctgtcggcagcctcggaagacaaaccagctttgatgttaaagaatattcatgatttaggtctggactgtatcgtatgtatcggcggaaacggaactcaaaagaccgcagccaaactggcccaagcaggtgtgaacgttgtttctgtacctaaaacaatagacaatgatgtttggggaacagacgtttcattcggattcgattctgccgtaaccattgctaccgatgccattgaccggctgcattctacagccagttcacaccaacgtgttatggttattgaagtaatgggacataaagctggctggattgcactttattccggaatggcgggaggcggtgacgtgattcttattcctgaactttcttatgacatacataacataggtaataccattattgaacgcttgaaaaaaggaaaaccctattctattgtcgttgtcgcagagggtatccaaaccatggacggcaagaaagccgccgaatatatagctcaagaaatagaatatgaaaccggattcgagacccgtgaaactgtattgggatatatccaacgtggcggctctcctactccctacgaccgtaatctggctactcgtatgggtggacatgctacagaactgatcgcttccggacaattcggacgaatggtctctctgcaaggtgcggaaattggctccatctctctgaatgaagtggctggtaaattaaaacttgtcaatgaaaaccatgacctgattgtacaaggtaaacggatgggaatctgcttcgggtaagaagcagattcattccttttccatatatttggatggagacactccgaattgctcggtaaaatgctttcggagcgtacgtgtatcactatatcctaccatttcggctatttcctgaatggaatacctgttctccataataagggaggcagccttgcccatccgtacactccggatcatatcaatagcagccaattcgctacgttgctttatttttctataaagggtaggctgactcatattcaattggtctgccaacatttttacattaaagttttcattcgccagattagcttctatgacatgaataatttgctgtataaaatcatccggagcattattcccatccgtttccggttcactttcctgctgcttcaacatcaacgtctttgtatatatcctcttcaggcgttcccgctggagtatcaggttccggacttttgccttcaatacctccggattgaagggtttcatcatataatcatccacacctatttttgaagcctgcaacacatccgcatcctcagcctttgccgtcagcatcaaaatagggatatgtgctgtccgaggctgctcacgcaattcccggcaacaggtaaacccatcttttacaggcatcattatatcagaaataatcaaatccggaattttacttattgccacatcaaccccctcttcaccgtttgccgcctcatatacggcataatctttacagaataaagaacagacatagtgccggatttcctcattgtcctcaataacaagaagagatgtttttttattcgaagacttgtcttcctgcccttccgcctgcattatcggtaacggaagagcatattcctccatctccggagtaccaacaatctcataccggtcctctgcaaaatgtgcatttccctcaggaatcaataatgtgaaagtgctaccctttccgagagtactgtccaaattcaccgtgccatgatgaagatccatcgtatttttaacaatacgcaagcctatgcctaccttattagaaaacaaaggtgtattttctccggtaataaatgattcaaaaatcctcccccgtaactcttccggtattcctttacctgtatccgatatgattatactgcaaaatgaatatccatctatctcaatacggttcatcttaaaaatcacctttccattcggagatgtatacttaaacgcattagataataaattacggatagccgaacttattttttccacgtctatccatagcaaaagtggctcattcagcgattcaaccgtaaagttaatcccttctgtttctgccagttcatgaaaagaatcggttatctgctttgccaataccactatatcgactttcgaaattcggagtttaatcatacctgcttcaatcttctgcacataaagcaaatgatcgaccaatgtctgcaaagaggttccattgcgatacatggcagccagtttagtatagacggtgtctgaagggcggacggttcctaacaattcctgcagaggagataagattaaagttaaaggtgtacgcaactcgtgagctgcattcgtaaagaaattctcgcgttccatccgaatctgcttctccttgtcacgttctacagtagcagcaaatatctcatgttccaagcgcaactcgtgctccaacctcttttgccgtaatttaatacgctgtataaccatataaactattatccctcccagcaccatcatacagaagcggaaaaagaaagtttcactccaatgaggcaaaatctctactctcaacgaggttattttactgtctctttcatccggataaatatttttcacctcaaaaacatattccccggcaggaaggttagcatacgaaactttttcccctccgttggccacaagccaatcaggctgataaggacgaagcctgtaactatacttctgctggctttcagaataagaaaggttattgaacgtcagcgcaaagtcacgattcgcatgattcaaccggacaaaaggcgtatagaaaatactttgtgaaagaatggtctgcccatttacctctcttcctatctctacaagtttattatttacctccaatccggtaatcacgacagattcggaagtggtaaacgctttaatgtcatcggggttaaaataagtaagattcttattattcccccaaaacagaacatcctcccaatgcaggacagaacggttactgcccgcaatgtaataattataaaacaaatgttgatgacgactataacgggaaatacctgaattagatcccagccagatttgcccgtgcgcatcctcagtcatacaaccaataaagttactgcacaatccatcccgggtagtatatacatgagttatcgcatcctgtccgggagagaaaactgccagaccggccatatatccgacatatagattaccatcggacgaagctaataatgaacgcacggaattctcaaccataccgtacttcttttcatagtcggtctgcagttcattttcatttatcactttacatataccataattagcagtgcccagccaaagcgtatgatcatcagtttcagccatagcacgaatataaagaggagacaaattctgtaacccggatactttaaaatgcatcttcttacacctgttcgtctcacggtcgaataaccagagtcctttatgtgtaccaatccaaaaatgacctttgctatcaaggaataaggcccaaactgatgatttgttaaggtcaccattttccgtaatcaatcgcaatatcttgaatgagcgttcctttttataataacaagtcaatgaaccatctaaatttccaaaccataaatttcctttctcatctttcagactgcacaacactgtctgttgttttttcacattttgatctcccacttgaaagaagtctattttttctgaagtaccaaacgctgttcggcttcgcataattcctttatggtatgttgccaaccaaagataatgatcgtcatccgctacaatagaacaaatctcattatgcctgtcctgataaaaacgattataaaactgcatacgcaaatccgaccagattactcctccaccatccgtaccaatccacagaataccatgtgaatcgtaataagccgcaatcatcctcgtttcaagattgcggtgcatcaaagaagaagtgttactataaatttctgtcaatatcccgtcctgattatttttatctattgtcatcactgtatatccattccacgttacggccaaatatctattctcattcaatttgataacaccgaaaacatctgtatgagaaagtttgtcggataccggagccacatgataagtcagctgcttgattttcccagtccgttcattataataaataaccccatgagcaattgtagaaatccatatccggccatcatcatacaaaacagaatttacagacagactaccggtacgacccaagtcaatcacccgaaagaaactcaggtttgtcacatccagcaagataattctacctttttcatcaatcaggcagatactttttttatccgaagaataagttatggcaaccaaaagattatcctgattatcccagcctgtatatttttcttcaacccggagccgaagttcaccttcttttgatgcgcaccgcttcattaaatgtaactcacttccggaaatcacccaaaccaacgaatcattcttctgcaacatccctcgagatggaatgccctgtcccgaagaagaaaccacagacaaaaagcgttcttttttcaaatcaaatgcagaaaatacaccattatccacaaatgccagcaccccatcaaaagcttccttcaagtttgagatactaggataactactacttatttcgaagtttgtaatccgcctgccgtcataacgactcaacccgtttcgggttccaaaccaaacgaaaccttctttatccttataaacagcagatacggtattatcggccaatccgttttgcatattgagcagatgcacatcttttgaaaaaaaagcataacacacatccggcagcaatatacatacttcaattataagcagtgataagattttaaggttcatatttaattcattacttgtagcaaaggaataaaataaaaaagagataacaacaaagattcaccaaaaaatatagagatgcattaaacgtgcatactgaatgaaatgaacatgtacaaaacgatttcattgattaacatacatttgcaatacattaacctaatgtctaattaaaaacagaaaagcatgaaaaaaaacttgattctatttttgatattgctttgtaactgtacattcctgtacgcccagcaattcaacatcaccggtgtagttacggataaaaagctcaaagaacctattattggtgccagtgtcattgtcaaaggaacaacctatggaacagtgacagatcttgacggaaattttacattacaagtttcaaaaggaaatgtgttggttatctcttttattggatacaccacacaagaaattaaagtaaatgaaaatcaattctcgtataacattcaaatgtctgaagacacacaaactttagatgaggtcgttgtagtcggtttcggtacacaaagaaaagctaatctgacagaagctgtagccacagtagataccaaaatactagattcccgccctgttaccaacttaggccaatcattacaaggtactattcccggtttaaatttatctgttggaggcttaggaggacaattaggacaaactatggatgtgaacatccgtggtacaggtacaatttctacaggttctaaagctgctaccttagtcctgattgacggtatagaaggtaacatgaacaacttgaatccagatgatgtagagtctatctccgtattgaaagatgcagccgctagctctatttatggttcacgtgcggcattcggtgttattttgattactaccaaaaaaggtaaagcaggaaaagctagcgtctcttattccggaaatgcccgttatgccggtcctaaccatttgccggatttaatgaattcctaccaatttgctaactattttaatgaaggtagtattaacggaggaggaaaagccatttttgatgaagataccatggaacgcatccagcaatacatgaatggtcaaattacaactagcactattgccaatgcaaatggtaactggcaattccatgaaaaagccaatgacaatgtaaactggtataaaactcattacaagtgggcatggtcccaagagcacaacctgaatatcaatggcggcagtgacaaaagtcaatattacgtatctgccaactatttggatcaggatggcaaccttcgttacggaaaagattcctatgaacgtatttcaaccaatgcaaaatttaacgcacagccttttaaatggttggatatagaagtcaatactaaatatgtttataccaaactagacaaccctctttatagcgacatgaatggactgttctatcatgatgtagtacgcatgtggcctacaatgccgtttaaagatcctaacggttactatatgcgcaacggaaaattagggcaacttactaatggaagccgctccatcaccagtaataataacgtttatctgcaaggacaacttgtttttcatcccttgaaaaactggaatatatatgcaaacgtagggttacgcttgattgaccaagtacaaagacagaatctgaataaagtatatgaacacaacgtagccggagaagcattagaactggcatacggtggagaatatgcggtgggacaaaccggagccatgcaatattggactaaagccaatcatttaacaaccagcctgtacagtgattattctttttcattcgatgaacatcaattcaaagtgatggcaggagttaatacagaaaaatacaataaccgttatctttctgtgaaacgtatggacctcattaccgaatcaatacccgaaatcggcgctgcaacaggtgaagataaaatcaatgaagccagtgcctatacttgggctacagcaggcttctttggacgtattaactatgattattctaataaatattttattgccggcaacttgcgatatgacggttcttctcgcttccttcgaaaagatcgttggggacttttcggttctttttctttaggctggaatatagcggccgaagattttttctctgtaaatgaaaacattatcaatcaattaaagcctcgtgtatcttggggcacactaggtaatcaaaatactaaatcttattatcccatgtatttattacaaacagtcaagaccaatggaggaagctggctaatgggggactctaaaccaactgttgccggtatgcctggaacccttagcagttcattgacttgggaaacagtacaatccttaaatatcggttttgatttaggaatgttaagaaatcggcttaacataaatttcgattattttatccgtaaaacattggatatggtcggtcctgcttctgaggtcgcttccatctatggcatcggtatgccagcaagcaataatacagacttacgtaccaaaggatgggaaatagcagccagttggcgcgacaagataggacagatcaattataatataggctttaacatggcagattcccgctcatttgttgacaagtatcccaatgaatctaaatcgctcagcacctattataaagaccaggaattaggagccatttgggggtatgtaacccatggaatagctaaaaatcaatcggaaatggatgaatggataaaagataacaatccctcatggggttcaggctggggcgaaggtgatattatgttcgaggatcttaatggagataaagtaatcaacgaaggagccaatacagtagacgatccgggagaccgcaaaattattggtaactccaccccacgtttcaggtttggtttagacttgggttgtgaatggaaaggcatcgactttagtatgttctggcaaggagtcgcaaaacgcgatttatggttggatggtcctatgttttggggaatatcgggaggagaatggcaatcaactggtttaaaagagcatttggattattatcgcccagaaaatacaacttctgtatttggtcctaataccaatgcttattttcctaaaatgtatatgagcaaagatatgaatcaaaaggtacaaacccgttacttacaaaacggtgcctatgcccgtttaaaaaatatccaactagggtatactttcccgacacaaattatcaacaaactacatatgcaaaaattacgtgtatatgtcagtgccgagaatgtattgactatcaccagtctacctagcggttttgatccagaaacaacttattcaagttattctgatgggaactccggaaaaacttatccgctacaaacaactatatcttttggattaaatgcaacattctaaataataaaacatatgaaaaagattctattatatacattcatagccgctgcaagtgctcttgcgacctcatgcaatgattatctggattgcgaacctatcacttctgtcagcaccaatgtctatctttattccgaaacagacctagctgcttatgctgccaaattttataatgacagtgaaaacgaaaacgatgacgaatatggcaatattcttccatctcatggttctgccacttataatttaggattattccaaaaagataatggaacagacgatcaaaccgcagactcaccaagtaaacttttcataaaaggacaataccatgtcggtgacgatgacttatggcataaatatttccgtaagatacgtgcagctaattactttattcaaactgtaaccgaacgatatgccaacagagaaatatccggtaatgatgcaaatatcaaacactatattggcgaggtatatttcttccgtgcttatatttatctcacagcattgcagaatctaggtgattttcctattctaactgaaatattaccggatgattacaatgccatacgtgaagcttccaaacggcgtccgcgtaatgaagttgcacgctttatcttatctgatttagataaagcctacgaatatatgcttcccactgctcccgtaagcaatcggttaaacaaagactgcgctgcattagtaaaaagtcgcgcagccctatttgaagcaacatgggaaaaatatcataaaggaagtgcatttgttcctggtggtcccggatggcctggtgcttcaatggattatttaaaagattttagcattgacattgactctgaaattaaatattttttacaacaggccatagaagcagctgatatcgtagctcaaggacacaatttgcacggaaattatgcctcgttattcaattctattgatttaagcggaatagatgaaatcttattatggcgtaaatacagtgtcaactcagatgccacttcttaccactttgtcgtaagctatttgcaacgcaatggcgggggaaacacaggctatacacgttccatggttaattcttatctaatgtctgatggcctacccatctatgccagtaccaattatcaaggagacgatacatatgaacatatctttaccgacagagatggacgtatgggacaaactattttaaaaacaggagatttgttatctgatgatccaaactttgccacttggataaagaagagtgatggatacggctacttttaccgccctgaaattttcgagacccaaaaagaaaatagtaatccgaccggatactgtctgcgcaaaggattgaatacatccggagatatgcagtcaacaaaagaatcctatacaggatgcccgatcttccgtgcagcagaagcctacctgaattatatagaagcttattacgaattaaacggaaatctaggtggcaactgcgataaatactggaaagctcttcgtgcacgtgccggtatgagtacagactatcaaaagaccataaacaatacagacataagtaaagaaaaacaagattggggaagttattctgccggtcaacaaataaacacaactctgtacaacatccgtcgtgaacgacgtgtcgagttggtatcagaaggattccgtatggcagacttaaaacgttggcgcgctttggaccaagtaaaagatgtacacgtacaaggatttaatttttgggatagcatgtatcaactgtatacaaaccctcaagccgaagacgctgtaaccccaattccccaaataacacttttagaatatggcgtaacagacaagacagccaatatttcagcaaaatccgacccatacgcagaaggaaaatatttattaccttatcgtaaaaatgctgctaatattggtttcaatggattaaactggaatacaagcaaatacttgtatcctattagtaacaagcaattccgcctgactaccgctgttccaggttctaatgaatatgaaagttctaccatttatcaaaaccccggatggagcagaaatgatggaactttacctgaaggtgaataaacaaacatagaagttttcagataacaatgtagagaaacagccctacaatcatttatgggaaggaaaaggaaaatttccgaaaagttttcctaccttcccatagcatattcacattatatgaatatctttgttttgaaaacataatcaatgtagcaatagactataattaccgatatggtgatagttttattttcttctaactaccgttttttcggtttattcttacgaactattctaggttgaaaaataaacatattatgaaaagattaatatcactattcttgttaactttaggaataatcttacctatcttagcacagcaaaaagaaatagatgtctacttagtaggtgggcaatcaaatgcaacaggacaagcttatgttaaaaatatcccagcctcttttaaaattgacacaagagtccgaatctattattctcgtttcctcaacaaaggagagggcagtgagcaatggaaccctttatgccaagcttctgaaacaaaaaataaattcggaatagagttaagtttaggtacaaagttacagtctttatatcccaagcctcaaattgcattgataaaacacgctttatctggttccaatctatatcaacaatggaatccgggaaaccgtcagaaaaatattcgtggcgaagaatatataaattttataaagactgtaaaagatgctatcatcagtttgaagcaacaaggatatcgccctattattaaggctatggtttggcaacaaggagaagcagatgcacgtgatatagctggaatggaacagtctcgccaatatagttcgaatctaaagaattttatagaacaaatacgaaaagaatttaatagcgaaaacatgttatttgtatatggaactgtcatacctatagccgcttctcgctttacagggcgtgaactggtaagaaaagcccaatttgctgtttccaacaactcaaactctgagttctccgttaataatgcattattaattccagcagacgatttacaaatgctatataatgactatcagatccagcacctaaagatgatgtacatttaggaatatatggcattctaacattaggtgagcgttttgctgatgctatttatcaacatttaaaataaaagttcttttatttgataattacacaataaaacacaatcagtcaggaatgatgaaacctctattaatcctttacagattatgaagaaaagacttaatattttcttgctggcattccctttgtgtccagtattccagattcaagctcaagaaaaacctaacttggtcttcatcatggcagaccaatggagaggaaatgctttaggttgtctcggaaaagagcctgtcaaaaccccttgcctggaccaactggcccgtgaaggtgtgaatttcaccaatgctgtcagcagctaccctgtatcttcaccggcaagaggcatgttgatgacaggcatgtatccgcataagaacaaagtaacaggcaattgcaattctgccaacgctccctacggagtagaacttccacaagatgcacgctgctggagtaatatacttaaagccaatggataccagacagggtatatcggcaaatggcatctggatgctccccataaaccatacgtagacacttacaacaaccaaggtgcagttgcttggaacgaatggtgtcccaaagaacgccggcacggtttcgactattggaccgcttatggcacttacgactaccatttaaaccccatgtactgggacactgacactccccgggatagtttttattatgtcaatcaatggggaccggagtatgaagccgacaaagcgattgagtacctcaataaacatatagataagacgcaaccattcgccttagtcgtatccatgaatcctccacacaccggttacgagctagtgcccgaccaatacaaggagatgtataaaaatctgaatgtagagacattatgtgccaaccgtcccgacattcccgccaaaggcactgaaatgggcgactatttccgcaacaatatccgcaattactacgcctgcatgaccggagtcgatgaaaatataggtcggataatcaacgaattgaaacgtttaggattatttaaaaacactatcgtagtattcacttctgaccacggcatctgcatgggagctcatgaacaagccggaaaagatatcttttatgaggaatccatgaggattcccgtccttatctcatggccggaaaaaataaagccgaaaaccgaccaaacaaccatgatagcttttgccgacttgtatccgaccctgctttccatcatgggctttcagcaacaaataccggaagaagtacaaacattcaacctcgcttctattctcctctgcggaaaagaaaacaactgcattgtccaaccctactattacatacagtcatccaatccagcaacaggctaccggggattgcgcaccgccacacatacatttactatccatgcaaccgatggaaaggtagataagattattctatttgacaggagatcagatccttatcaaatgaataatatagctatgcagcatcccaaattagtaaaccgactgaaaagccaattaaaaacatggctacaaaaaacagaagatccattttttaattatttataacccatgaagatactatatatatcccttctcttccttatgaactgtgtactgagtgttgcacaaccggaaatcattatacccaaaccgcatcaattgaaatggcatgaggcggaaatgggagccgtatttcattatgacctccacgtattcgacggcatccgctacggacaaggcaataaccgtatcagtcccattgaagattacaacattttcaaccccacccaattgaataccgaccaatgggtctcagcagctaaagccgcaggctgcaaattcgccgtactcacagccacccatgaaaccggcttcggattgtggcaaagtgacgtaaacccatactgcctgaaagctgtaaaatggcgtaacggcaaaggagacattatccgcgattttgtcaactcctgccgtaaatatggtatccagccaggcatctatgtaggcatccggtggaattcactcctgggtatccataatttcaaggtagccggtgacggagaatttgccgccaacagacaggcgtggtataaacgcttctgtgaaaaaatggtggaagaactttgtacccgatatggagatttatatatgatttggtttgatggcggagccgatgacccacgaggtgacggtcctgatgtggaacccatcgtcaataaataccagcccaactgcctgttttaccacaacatagaccgtgctgatttccgttggggaggttcagaaaccggcacagtgggatacccctgctggtctactttcccagccccctgttcacatcataaacgtattgaaagccaaaaagaccaaatagcattattaaaacaaggtgatcccgaaggaaaatactgggtaccagctatggcagacagtcccctgcgcggtgccaacggccgccacgaatggttttgggaacccgatgacgagaataatatctatccattgacaacgttgatggatatgtacgaaaaatcagtgggacgcaacgctacgttaatcattggactgacccccgatcccgatgggctattgccagcaggtgacgaacagcgtttaaaagaatggggagaagaaataaaccggcgctttggcacgccattggtagaaacccaaggccggaagcaacggcttacgctgaatctgaatgaaaagcaaccggtcaactactgtattatccaagaagacattaccaaaggcgaaagaatacgccaatacaagatagaagcgaaagtcaacggaaaatggcagacagtatgctccggcgagtctgtgggacacaaacgcattgcgcacttcgaatcggtagaaaccaccgccttgcgcctcaccgtcacgcaatccgttgccttacccgcaatcagctatttcagcgcctataacgtaaccctcaaataaaaaatcatgagagaatatacagcaatattcatttgtattctaatttgcaatgtatttatttgttcgaaatccttcgggcaaacagattacacgtataaaaaaggaaagtcattcaagagtacaaacgctttgtcaatgacagatacgattgatttaacttccatttcttctcccataccctataagaaatccagacccggacaaatccagactattgcctgtccggtacggttacctgggtacgtccgaggtattttcttcagccgagactcccgtccgggagattttgaatggcccaacaataccaaccgactcctaccttgggtgttcaacgatttaaaagaattaaccgacacccgctatccgggaataccttccaatgcagccccatctacgttgggagatgcattattgctggaactgacaaacggagaatacttgtttgccaaagccattgccggccgtaacagtttaagctggctgcaagtaaacgataacggctctgtcaccctatatgtatccaccttaggaaaagactatctgaaaccggaagtccctcttctactcatccgacaaggaaaagatatttattcaaccattcggcaagcctatcaagcgctgatgaaaaatacagaagccgccgacttaaaaagccgcacagccaaggaatatttcgaagctttccgctatctcggttggtgtacatgggaacattatcatgatgatataaacgaatccaaggtaataaacgatatgaaaacgatagaggcatccggcattcctatccggtatgtactgattgacgacggtcatctcgcccacaagaacaggcaactgaccgatttcataccggataaacaacgtttcccgtcgggatggaaaaaaatcatgtcatacaaaaaagaaaataaaatcaaatggatcggactgtggtacagcctttcgggatactggatgggattatcccccgaaaacggatttccacaagtcgtccgacaagccctatacccacacgccggcagccttctgccaggaacggacagcacccgcatccgttccttctatcgctactacgtcagcaccttaaaagaacaaggattcgattttctgaaagtagataaccaagcttttacactaccactctacatgggaggccatgaaagtatccgccaggcaaccgactgtaaccgaagcctagaagccgagacccaccggcaaaatatgggactaatgaactgtatggcacagaacgtcatcaatactgaccatacgtcatacagtaacagcacccgtgtcagcatagactataagaaatatgatgaggatatggcaaaatcacatctattccagtcttataccaataccttgctactaggacaaaccgtatggcccgaccatgatatgtttcattcctgcgataccgtttgcggcaccttgatggcacgttccaaggctatttccggaggtccggtctacctgtcggacgcccctcgggactttatcaaggaaaacattttccccttaattgacgaacaaggcaaactgttccgtcccgaagctcccgccgtacctatgccagaatctatactgaccaatccattatggagtggaaaagcgtatcgagtagcagctccctcaggcaacggagcaatgacattaatctgttacaacctgaatgtttccccccggcatcagcaagtccaagccattataaaaaaagaagattattctcttcggaacagttttgaaaaaatgtctgccacctccgaagaacgcgtgctgctttataattgggaatcacaaaaggcagaagaactatcagacagcagtacattcgaactcatcggatttacagacaaactgtttcatctctgccccatacggaaaggatgggcagtcattggcgtacaggaaaaatatctatccccgagcaccgtccaaactatctctttaacagagaatcggttggagctgaacgtactatgtacaggtacactaaaagtatggatagaaaattccagcaagcaagaactgagaagtatttccatagataccccccaaaaaattgtaatcgaaaaataacttataaaaccagccgatatgaataaaaaactacttgtatctttcgctctcgcttccttaacaggaatctcgacgcaagcaaaagaaaaaatgtcttcagaaacaacccaacaacgtcccaatatcatcttatttatggtggacgacatgggttggcaagatacatccttacctttctggacacagaaaacccactataacgaaacctatgaaacccccaatatggaacgtctggccaaaaaagggatgatgttcacacaggcatacgcctgcaatatcagttccgctacccgttgcagtctgataacgggtgccaacaacacccgacatcgtgtaacaaactggacgcttgaaaaaaacaaagctaccgacagaccaagcaatacaatacaattgccagactggaactacaacggagtcagccaagtaacaggaacgtccaatacctttgtcggcacttctttcgttgagttactcagacagaacggttatcataccatccactgcggaaaagctcatttcggttctattgacacaccgggagagaaccctacccattgggggtttgaagtaaatatagccggacatgccgccggtggtctggctacttatctgagcgaacagaactacgggcacacccgcgatggaaaaccctattcactaatggctatccccggcttggaagattattggggaacaggtatatttgctacagaagccctgacacgagaagctatcaaagcattggacaaagcaaaaaaatacaatcaacctttttatctatatatggcacattatgccatccacgttcctgttgacaaagatatgcgcttcttccccaagtatattaaaaaaggacttagtgacaaagaagccgcatatgcatccttaattgaaggaatggataaaagtctgggggatttgatgaactggttggaaaaaaatgatgaagcagataataccgttattatttttatgagtgacaacggagggctagctgccgaacccggatggcgcgacggacaaattcacactcaaaacgctcctctcaacagtggtaaaggctccttatatgaaggaggaatacgcgaaccaatgattgtaagctggcccggagtagtcaccccagatactcgttgtgacaaatatcttataattgaagatttttatcctaccatacttgaaatggcgggtatcacaaactataagacagtcaaccctatagacggtatcagctttatgcccctgctgaaaggtacaggagacccgtctaaaggacgcgcactggtatggaatttccctaatatctggggtaatgacgggccaggcatcaatctggcctgctctatccgcaaagacgaatggaaactggtctattattatgaaaccggtaaaaaagaacttttcaacataccaaatgatatcagtgaaaaaaatgatgtagcaaagcaacatcccggcatcgtaaaacggctctccaaggaattagggaactatttgcgagcaacaggaggacaacgtcccacattcaaagccaccggaaaaccctgcccgtggccagatgaaatctaactcctgtcagtatatgaaatatgcccgactacattttcttaatgtaatcgggcacattccaatgtattatgtattcctgccgaacatttctcaagccaccggaatagctaattaataaattataaacaatatcaataaaatccgctaagcgttttccttaaaagccttttcttccgcttcactgattatctgctcaaccacatccgttttcttaatctcctccaaagaaagatccggagtaacggccccactgtctgaaggcttacgatcagaaaccgttacctcctcctgagataactcacgggcagccttagccgcaaaaatacattcaataaaaccggaatcattcttgatttttcccaaagccacacgcgcagccatttgctgagactcttttttagaataaccggttccttttcctcccgaaataccttccaccaaaacttcactctcgaaagtaggattatatccctgatcgtgtgattgggttatcagctcaaaggtaacctcaaaacgatttttttgactccattctatcaacttggatttaaaatttacctccttacgggaaatcttctccaaatttatataagatccaataatacgatgctccatgaaatatttacaggcacgatatcccctgtctaaataaatagcacctaccaatgcttcgaatgcattgccgcacatatagctgttatgagaagactggcgggctgtatacttgatcagcttatccaaaccaatctctatagccaaacgattcaatgtttcacgctgcactattttagaacgggtgttcgtgagaaaaccctcacgctttccttcaaaccttttgtaaacaatatctgccaccacagcatccaaaatagcatcccccaaaaattccaaacgttcattattaagcaaacgccccttttcagacttcactgataaagatttgtgaagcaaagcctgttcgtagatgctaatatctttgggatagaatccaagcatcttataaaaacgaaaataagactccctatccttacgaaaaagaagtcttatcctatcttttatattgctaaacacgactattcagcatatttttttacgattacacatgcattatgtccaccaaaaccaaaggtattgctcaatgcagcgtttactgtacgtttctgagcttcgttgaacgtgaagttcaagttataatcaatgttttcatcattatcaccttcctcatggttgatagtcggcggaacaatgtcgttcttcacagccaatacactggcaatagcttctaccgcaccggcagcacccaacaagtgtcctgtcatagacttagtagagctgatattcagtttataagcgtgatctccaaatacatccttgatagctttcacttctgaaacatcacctacaggagtcgaagttccatgtacattgatataatcaatgtcttccggcttcaattccgcatcttccaatgcgttcaacatcaccaatttagcgcccaatccttccggatgagaagctgtcaagtgataagcgtcggcagaagcgcctacaccggcaagttccgcataaatcttggcaccacgtgcttttgcatgttccaattcttccaaaatcagacagcctgcgccttcacccatcacaaagccatcacggcttgcgctaaacggacgggatgcacgttccggatcatcgttacgggtagacaaagcatgcatagcgttaaaaccgcctaaaccagcttcaaaaattgcagcttccgcaccacctgccacaattacatttgctttacccaaacggatatagttaaatgcatcggcaatagcatttgatgaagatgcacaggcagaagttgttgtgaagttaggaccgtggaaaccatacatgatagagatctgtcccgatgcaatatcagctatcattttggggataaagaatgggttgaatttcggtccgacagtatctttattcagtgtataattagctacttcttcttcaaaagtatgaatacctccgatacctacaccgtaaattacacctattctattcaaatcttctttttcgaggtccattccagaatcctccaccgcttctttagcagctgcaatggcatactgtgtatacagatccattttgcgaagttctttacggtcaatgtaatcagttccattgaaattcttcacttcgcatgcaaaatgagtcttgaatttagacgcatcgaaatgagtaataggccctgccccgcttatccccttcaccaggttttcccatgtttctgcaacattgttacctacaggagtaagagcaccaagacctgttactactactctttttaattccatattataaaataaggataattacttagcgttagcttcgatataagaaacggcgtcacctactgtaccaattttctcagcctgatcatcaggaatagaaataccgaattctttttcgaattccataatcagttctacagtatccagtgaatctgcgcccagatcgttagtgaagcttgcttctgttgtaacttctgattcttctacacctaatttatcaacgataatagcttttactcttgatgcaatttcagacataactttaattttttagttaataaattgaattattttattttctttgcggttgcaaaggaataaatatttcttgggctgagcaaatattcaggcaaataaatgcagaattttgcacatttttttgttttatgtgcaccaaaatagagatcatcatgaagaaaatcgcaattttagcttcaggagaaggcacgaatgctgaaagaattattcggtattttttagagaaaagaacagctgaagtagcattggttatcgtcaacaaagcacaggccggtgtactcaagcgggctgaaagactgagtgttccgtcacttatcctcacagctcaagaatttgccgacgggaaagtactggaaacactgcaccaatatcatattgactttattgtactggcaggctttctcttgaaagtacctgatgccattttgcatgattatccgaataaaatagtaaatattcatccggccctccttcccaagttcggtggtaaaggtatgtatggttcccgcgtgcaccaagctgtcatagcttcccatgaaaagaaaagcggcatcaccatccattatataaatgaacaatatgatgaaggaaataccattttccaagccacctgtccggtattacccactgacacgccagatacattggcaacacgggtgcaccagttggaatacgaatatttccctcgggtgattgaagcgactattttaggcaaaaatctttcaatctaatacgaaaaaactgaagagctttgcctatccgataattgacagtctgcaccgacacctccagcgtgtcagcaatttctttatgggtcagttgtttatatcgactcataacatatactttttgctgttctttaggaagagcatgaagagcttccatataggcattaaacaactccgtgctataaaaagaatccaatgccggcagagattttaactgttggctctggtactcttcatatacctgacgggtaatatgggaacgggtgattgaattcaatgccctgttcctgacactggtaaataagaaagatttcagcgacaagtcctctaccagcgactcacgcttttcccacacatacatcatcaaatcctgcactatttcttcagcctcttcaagagaaacatacgaggaacaaaacaaacatagcggcttgtaataagaagcataaaccagggaaaatactttttgatcccctgacctcaaggttttaataattaagcggttatcattaaggttcataggtcatttttaatttaaggttacacaaacataagtatttatttcaaaataagaaaacaagaatgagataaaatacaaaaaatataagtttttgtttagtaacccggttatgatatttgtattaataatgttgaccgacttaaagagagattaacagaaaccttaataaataaaccttgataagttaaccttaaactgaatgcctatgcgaaaaattatcaaatcaaacctattgggtaaacatacccaattatcaacaaacctattatttaatctaaaaacaaaaatctaattaagaacgaacctcaaaatctaaccttatgagacgaatttttacttttttcctgacattcctattgggaatgtttgtaacagcattgtatgcacaaacgcatacagtcagcggtactgtaatagataaagacgctaacgaacctctgatcggcgcaaacgtattaattaaaggtacaactatcggaacagtgaccgacctcgacggaaagtataccctgcaagccggcgacaaagacattctggtattctcctatttaagtatgaaaaccatcgaggaacctgtaaacggacgtacagtaatcaacgtaaaaatgacatcggacacagaaacactgggtgaagtcgtagtgacggcaatgggtattaaacgacaatccgagacactaacctattctgcgcaaacagtaggaggtaaagacgttaatgacatcaagagcgtcaatatgattaactccctgcaaggtaaaagtgccggtatgatgattacaccgaactcaaccggagccggcggttcttccaagattctgttccgtggcaataagtccatcagcggtaataaccagccattagtagtagtagacggagttcctgtcatgatgaatatcaccaattcacaggtagacagcaactacggaggccagcgagacggtggtgacgccatgtctacaatcaatccggacgacatcgcccaaatcaccttgctgaaaggtgcatcggcagcagcactttatggtgcggtagcagccaatggcgccattatgattaccaccaaatcagcacagtcgggtaaagtttccgttaatgtatccagcaacaccacaatggagagcccaatggtgctacccgaattccagactacttatgggatgagcgacaacggtactttcagctggggtgagaaactaagcagcaaagctccaaactatgcaaaaaaattcttccgtaccggatttacaacgaataactctatctccttaagcgggggtaatgaaaacatccaatcttatttttcctatgccaatgtctattcacaaggtatcactccccagaatgactaccgaagccacaatttgaattcaaaagtaggtttcaatattctgaaagacattcatattgatttcacggccaagtttaccaaccagcacatcaccaatcaggcagctgccggctatttatggaatccgctgaccggtgtttatctcttccctagaggagaagactggaatggctataaagagaacttcgaggtatatgatcccgcaagaggctgctatgtccaaaactggacaaatacacaacaacagcaattcggtaatccatattggatgttaaacagacagaccccgatcactgaccgtaaccgctatgaatttggcggaagcatcaaatgggacataactccagatctgaatatccaaggacgtatgcgttacgaaagaggagaagaacactgggtacacaatgcttacgcatccagcgtaggaaacctttatccgatgggacgcatgaaagacaaccgctatttcagtgaccaactttatggcgatgtcttggtaagctacaaccatacattcaatgatttttctctatctgctaccgcaggttccagttttacaaaaaccaaaacctctcatgtagacctatggggtgagggctcccagttctcacagcccggttccggaaacattttttatccgaacatctttactccgaacaactattatggcaatatgtccaccgtgggcaaagatgacaactggatgacccaaaaacggctgaactcagtattcgccaccgcacaacttggttatcgtgaaggcatattccttgatatatcagcacgtaatgactggtcttcggcattagctttcacagaaagctgttcattcttttatccctcttttggcggtagtgtcctgctgaacaaatttgtagatatgggtaagaacattgatctgttcaaattccgcgcaagctattctatcgtaggtaatgacgtacctgtattcatgagtaatctgctctattctctaggttctcaaggtgctatcactccccccgacaaagctccgttcagaacattgaagccggaaaaaactcattctttagaaattggttttgacggtacattcttacagaaccgactgaatatcaatctgacttattataagaccaacaccaagaatcagttcttctccgttgcggctccttacgaatcaggcttgagaaaccgttatgtaaacgccggtaatgtagaaaacaaaggctttgaattcaacatcggatggtatgagcagttcactgaccacttcagttggagtaccaacctaaacttctcttacaatgacaataagattaaagaattggtagatgaccttcccaacggactgacattgaccgatttcggaggtgcaaaagtgatcttgaaagaaggcggccactacggagatttatatgtacgtcacctgatgcgtaatgaaaacggcaagcccctgcaaaacgaaaaaggagagcctatcgtaagtggtgattctatggacgaactggaatacgcaggcaatatgaatgccaaagtaaatatgggatggacgaacacattccgctacaaggacttctcactatcattcctgattgatgctaaattcggtggaaaagtgatcggtatgaccgaagcggctctagacggttggggcgtgtccaaacgttcaggtgaagcccgtgacgccggcggtattacagtagacggagtaaaatttgatgccgataagtactatcgcaccaccggtaacaataacttcaacagtccatacgctgtagaaaactacgtttatgatgcaaccaatatacgccttcgcgaagtaactttcggctacaccttccgtaacctgttaggtgcgggcaagaacctgaccgcagccatcatcggccgcaacttgttcttcttccacaaagacgccccgatggatccggacgtatcagcaggtacaggcaatggtatacaaggtgtagatatgtttgcactgcctacctcacgcagttttggtcttaatttaaaacttaacttctaatgcttgaaactatgaaacggaataagatattaacatacgcctttttaatggcattcccaatgaccgtaggaagtatcttctcttcctgcacagacgattttgaaaaattgaataccagtaacatccaggtaaatccggcagatcttccttttgccgcacaatgtaccgaaccgatgacctactgttatcctcctcagcaaaatatgttccagttttggaccaacctgaccattgacctttatggaggttactttatgactcccaacggtaacttcaccaacggtgatatgggagagaaccggggacatagtggcggtatgtatgagaactattatctccatattttcaacaacacccgccgcatcatcgcacaatgcgacgccagtggtgaaagaggtctgtcaggcgtgatgcgtatcgtacaggcttacggaacattgatgactacagatgcctacggaccgataccttacagttccatcctgtcgggcgaaaacgaagtgtatttcgagttcgacagccagaaagacctatataaagccatgcttgaagatctgagtacagccattactgacatcagtgccatgggagcagatgaaatagccaaattgaaatcctttgactgttggtgcaacggcgacaaagacctatgggtaaaaatagccaatacgatgaaactacgcatggcgttacgcctgtccaaacgggaaaccgaagccagcaacgccggaatgaaccttaaggcaatcgctaccgaggctgcccaaaacaccttggcaacagtcaacaaggatattctgatcgataaaagtcttgagaatgaaatgtggctgatgttcaattggggtgattgtggattcaatgccaatctggtaactattatgagtggaaccaaagatccgcgccaaccattatatatgaccctgaataccggagatatcaaaaacgaagccggtactaccacagtagccgccaatagtcaatatctgggtatccgttttgccagcggcctgcctgccaaaccaaacagttggggtagcttctccggttggattcagggaaacaacggttcctcttattccatgccactgcctatcatgaaagcagcggaagcctatttcctattggctgaagcaaaattaagatgggatattggcagtgaaagtgtaaagaacctatatgaaaatggaatccgtgtttccatgactaatgaattagcttatcggggggcttatgccggaatcaaagaatatccggaaggagcagtagacgcctacatcaatggaacaagcacccaaatagactatacagatcccatcaaagccgaattaagtaccccggctgtaaataaattaagtgtaaaatgggatgagagcgcaagcaacgaagaaaaactggaaagaatcatcacccaaaaatggctcgccctattccccctatccaccgaaggctgggcagaacaacgccgcaccggctatccacgcttctttcctgcattcgtcaatgaaagtaatggagccgtaaacacagaagaaggtgtacgccgcgtaatttatagcagccaggcttatgatgccaacgctaagggagtagaaggcggaatcaaacttctggaccaagaaaattccagcaaatttggcatctccggtgacaaaggcggaacacatctttggtgggacaatgctgataaaggaaacttttaaatgcaatattttaaggtaaaaactgtgatttttgtttcaataggcatttcatattaaagtttcggatagggcaggccgtgaggtttgccctatttttgtttacagcatatcacttattctggatactttgggtttgcgccagtcctataccatatcctttcggttcgttccggcttcccgatacagggcagttttttggcaattactacattcttcaaacatatcatctgtcatcatcatcaagcgaaagcgtaaaagtgcccaagcggtatgaataatccggctcaccgagcataattcgggaaacattcactaaaaacaatatttccggttgatttaatcgcacaaacctaccagatgtaaaaccggtgaagtggagggagtaagagtttacggcaattgccgcataagtgttaatttaacgcttaacgaactattatcataaattaaattgaataaactttgctgattatcaaattattattataactttgcgattattctaaaaaacgtttgcctattaagaacgttttttgattaggaatgacaaagttattttatatactcagtttgctgattattaaagtagcaagcaattacattagtacacatttatggtcaggtgaaaaaaaactgaagaaacgcgtattattgcaaactttgattctaacagcctgcttcctgcccactcatggacaagacagttttttatgtttccaaacaaatgttcaaaagagtaatatcagcatacacgaacaaagaatgaaacatcccgggcattcccaaaccgcgtgtgttcactctaagcatatcggcattggaaatgaagataccggcaatgaccatggagccggaaaaacgaaatacaataagtcggttccatttctcgccctgaaaacaaacatgctgtttgacattgctttaataccaaacatagaagtcgaagttcccgttggcaaatgttggtcgctcaacggcgaattgatgtttccgtggtggctgtttgataacgacaaatactgtatgcaaatattatccggaggactggaaacacgttactggctagacaacaagaagaaacgaaatatccttacggggcacttcgccgggctgtatgccggaggcggaaagtacgatttgcaatggaaagagaatggctatcaaggagaattcttcattgccgcaggaatcagctacggatatgcaaaacgcatttcccgaaatctgcatttggaattcaacctcggaataggagtgctgagaacctattacaaacattaccacgccaacgataaccatcagacattgttgtggcaaaacaacggacgatatacatggtttggtcccaccaaagctaaaatctcccttgcatggatattaaaccataaagtaaaaggaggtgtaaaatgagaatgcgttttatcttgctttcctttctgcttttcatatcttgcgataggcgcgaacttacctactatgaagttgtgggagtcaccctcatggcagactggagccaagccggactggagggagaagacacctatggcgcgacggccgttttctatccccaaaatggaggagtgcctcaaaccgtactgatgggtaatcgtactcacgccatcacccgtttgcccaaaggacattataacgtgatcttattcaaccgttcattcagtgatttcggcggcattgctttccgaggagagaatgctttccacaccttcgaagcgtatgccaaacaaatagaaaatcgttccgcaagcgaagttagcgttacctcacccgaaaagctggcaacctgcgtcatcgagggatttgaagtgacggacaacatagaatgctcactgcacttcacccctaccgagctgacaagcacagtgaaagtgcagattagcatagacggactgaacaacataaaagatgctacttgccgccttggaggcatccacgcctccatattgctgcacaacggccaatgcggtgaaaagatgattacacaggaattttccataggaaacccgaccttccacgaaggatctttcaccgacggcactcttacaggcgaaatctgtgttttcggatttgacgaagaaaccgaccacagcatgagtctgagtgccaatctagtagacggaaagactaagatagaacaaaacttcgataaagtgagtatctcaaaagacacagatgaaacaggtgccatctacctacatatagaagcaaaaacacccggacgaatacctgatgtagaacctgaaaaagatcccaactccggtttcaatgcagatgtaaacgactgggggaaagaagaaaacacagaattgcctttgtaaaacaaaagtataatactaatcaataaaaaaatgagaacaaaacatttattaatggcgatagcaacgttactggtggcaggttgttcgcagaatgaaattacggaggtcagaacagtcggtaatccagctgtcggattcgatgtctacacgggggtggcgaccagaggcacagatgtttctaccacaaccatgcaaggaacatgtgacgagacccattatggcggtttcggcattatgggatattacacagggagtaaaaattgggatgaggctaaaggaaccgtaactccatcttttatgttcaatcaaaaagtgacttatgacacaaatgcaaatgaatggacttattccccgacaaagtattggccgaacaacacgacagacaaagtgtctttctttgcctatgctccttatgagagcaatgtatccggaggccgtgtaggaatcgtgacttcccaaattgatgataccggcataccttctattgatttcacattgaaagaagcaaccaaaattgatgaaatggtagacttggttgtagctgaagaattaaacaaaacagcacaagatgaggccatacaattcaacttcaggcatacactttctaaaataaacacatagcggaattgcaaatttgagcaaagcgtagcgaattagctgaaagagcgttcgttacgctttgtttttctattgtgcagagccaacggaatgccaccccgaagccaaacggtgcagaagttcagttaccacttcattacccccgtaatgggtgcatatttcttgctaaatggttctttttctgcgatttgcgtaattctgcatagctgtcggtaactcactataaactaattttgtaaccaaaaaaaggagtgagttatgcgaagtacattcaaggtcttattttacgtgaagaaaggcagcgagaagcctaacggcaacctgcctttgatgtgccgccttacggtggacggagagattaaacagtttagttgcaagatggacgttcccctgcggttgtgggacgtgaagaacaaccgtgcttcgggcaagagcgtcgaagcgcaaagaatcaacctcgcggtggataaaatccgagtggaggtaaaccgccgctaccaagaactgatgcagacggacgggtatgttactgccgccaagttgaaagacgcctatctcggtatcggcgtcaagcaggaaaccttgctgaagctgttcgagcagcacaacgccgagttcgccaagaaagtcgggcacagcagggcgcaggggacattcacccgttatcggacggtctgcaaccacattcgggagtttctgccccatacctacaagcgcgaggacattccgctaaaggaactcaacctcacattcatcaacgacttcgagtatttcctgcgcacggagaagaaatgccgcaccaataccgtgtggggctacatgattgtgctgaaacacatcgtttccatagcgaggaacgacgggcgtctgccgttcaacccctttgcagggtacatcaactcgcccgaaagcgtcgataggggctaccttacccaaaaggagatacagacgctcatggacgcaccgatgaagaacacctgccatgaactcgtacgggacttgttcgtcttttcggtgttcacgggtttggcgtactcggacgtgaagaacctcaccgccgaccgcctgcaaacattcttcgacggcaacctatggataatcacccgacggaagaaaaccaacaccgaatcgaacatccgccttttagacgttcccaaacgtatcatcgagaaatacaaggggctggctcgggacggtcatgtttttcccgttccgagcaacggcagttgcaacaaaatactcaaagagataggcagacaatgcggcttcaaggttcgtttgacctaccatgtagcccgccacacgaacgccacgaccgtacttttgtcgcacggcgtacccatcgaaaccgtgagccgcctattggggcacacgaatatcaagaccacgcagatatacgccaaaatcaccgcccagaagataagccaagacatggaaaccttgtcgcacaagctggaggagatggagaagaatatctgccgagccatttagccaccttaaaactacataccgatgaaagaagaaaggaacatcatcacgatagatgaatacggcaatatctccctgccgaccgatataggcgcaaccgccatgaccgagtgggaaatctgcgaattgttcggggttatcgccccgacggttcgggcagggataaaggcactctgcaagagcggagttttgaaagagtacggcatcgaacgccttatccgtctatcggacggaagcagcatagaggtttacgacctcgaaacgataaccgccctcgctttccgtgtcgaatcgttcggggcggcgaaagtccgcaaagtgttgttggagcggataacgcaccggcgaaaagagaaaacgacggttatcgtgtctgtcgttgccgacaccgagccgagccgccgatggatggcgtaacggtctgtcggtcggggtatcagtccgttaccgggacagtctgccgattgactcataatgacggaattaaacgactgtccctaattataagaaagtattaatgcaaattgcacgtgtgtataatgatgcgatgaatatcattcactatatgcacgataaatattattatgaaaaggctcaaatggcattcattgataccgatccacgtatcaatctggcatatggcgtagccggtctgtccattgccattgactcattgtctgccatcaaatacggcaaagtacgtgccaaacgtaatgatataggtttgaccgaaggctttgatattgaaaatgcatatccttgcttcggtaatgatgatgaccgcgtagaccacttaggggtagatttggtttatttcttcagtgaagaattaaagaaacatccggtatacaaaaatgcccgccctaccctgtcactgctgactatcacctccaatgtaatgtacggcaagaaaacaggtgccactcctgatggtcgtgccaaaggagtggctttcgctccgggtgccaacccgatgcacggacgtgacaagaacggtgccatcgcctcattgagttctgtagccaaactacgctatcgtgatgcccaggacggcatcagtaacacgttctctatcgtaccaaaatcactaggggtagaccaggaaacccgtatagagaacctggtaaccatgatggacggttatttcaccaaaggagcacatcatctgaatgtaaatgtgctgaaccgtgaaatgttggaagatgcaatggaacatcctgaaaaatacccgcaactaaccatccgcgtatcaggttatgccgtaaacttcatcaaattgagccgtgaacatcagctggaagtaatcagccgttctttccacgaaagaatgtaacatcacatatacattcatcgtaggggcgggttttaaacctgcccttaccagtttaaagacaaaccattatgatcagagtccattcttacgagtcaatggggacgtttgacggtcccggtttacgcttagtcgtatttttacaaggatgcaatttccgatgcctctattgtgccaaccccgacacaattgacaccaaaggtgaaagtacggaaacaacaatagacgaaattgtgcgtatggccgtcagccaaaaagcttttttcggtaaaaaaggaggtgtgactttcagcggcggcgagcctacattgcaagcaaaagcactgattccgttattccagcgattaaaagaacaaagcatccacatctgtatagataccaacggcagtatatggaatgaagaagtaaaggaactgctacaatggacagacctcgtattattagacatcaaggaatttaataatgtgcgccatcggcaactgacagaacgcagcaacgaacaaaccatacgtaccgccggatggcttgaaaaaaacggaaagcctttttggttgcgctatgtattagttccaggctatagttcctttgaggaagatatacgggcattaggagagcacttcaagaattatcaaatgattcaaagagtagaaatactaccttatcatacattaggcgtacacaaatatgaagccatgggaaaagaatacaaactaaacggaataaaagaaaatactctaaaacaattggaaacagccaaaacgttatttggtgaatatttcaataccgtatatttaaattaaaaatatactgaagacaagatgttgctataaatcaatggaaatatttcatcatttcaataaaattatctaatttcgcatctaaaacataaattattataaatatgaaaagactactattactctgcctaacttacattatgtgtgtaggcaaccatcagatggctgctcaagactcttctgaaagtcctggtatttttaattcattagctgtaggcgtcagtgcaagtaccacaggtataggtattgatgtagccagtcctataggaagttacttggctgtacgtgcaggagtttcttttatgccgaactttacttattctacagatgtggatgtagatattgaaggttcttatgaaggaaatatacctaccagcatagatgtagaaggaggaatgggacgtactgccggtgaaatattgctgaatgtatatcctttcaaatcatccagtttttttgtatgcggtggtgcttatttcggaggaggaaaactcatcaagattaaagggcacagcgatgagttggcagaactgattaaagaaggacaagaagtaggtattgaaatcggaaactatcgtatacctgtagatcagaacggaaatatatctggtggtttgaaggtttcttcattccgtccttatcttggactaggtttcggaagagcgattcctaagaaacgaattggcttcatgttcgaaatgggtgtgcaattccataacactcccaaagtatataccaataacggagatttgtctgatttaacagcagaagctgataatgatttcactgatatcatagacaaacttactgtctatccggtacttaagttccgtttgtgtggcaaaatattctaataatattctataaaataaaaggagatgagccctataattttcgcctcatctcctttttatatataagaaacaatacacttatatcagcaccaccatcacatcacgtgccccatgagcacccattaccaaagcctgctcaatatcagccgtctttgacggaccggaaataaaggttccgaagccatattcgcctgtatcaatcagtttatatgcttcatgcatattgttcacaatcttattcttgtttagaagaataaccaatttttcggcaataaaataaatggcacgctgctttacatcctgttctatccataccgcaccattctccgcaaccccaatctttccatctataacggccaaatccgtcccattcagttctgcagggtcttccacatcatcgggattaaatgtcgcacatgtaatagtcttcagattagaagcgatgcgtttggctccaggataagcctttttaatgaaatcattcacgtcctcctctttctccaaaagaatggcttcccctcctacctgcttcatgatgagataaaactgttccaccttactgggataagttaatgccatatcttccaatggctttaaatccggtttctcatattttacatgtgtagcacgccggatgctctgcaatatatcttctctgctgctcataattacttcactttacctttcttccacatttcattgaaactctccttagcaaatttcggcatctcacgcccttttccccagtcattcaatccgttatagataagaaaacgtggcattccgtttaccaatggcgcccattttaatgccatattgaatatcaaagggcgattcatcatgaattccatgccaccggacattacccttttcatccggtctgccttacccaatttatccaaatcctgacgccacagatagatctgctccgccaaatccaccttagccggacacacaaacgaacaggaataacacaaagaacaagccgacacattgtcataataatgcaacggcgccttcaacattcccaggttaatcccgatagggccgggaataaaataagtataagagtaccccccactacgtctatatacaggacatgtattcatacaggctccacaacggatacaattcaaagttttgatatgcttttggtcggccaatatcttactacgtccgttatctacaataataatgtgaagctccccaccctctctaggctttcggtaatgagaagtatatgtagtaatgggttgtcctgtagccgaacgggccaacaagcgggtgaacactcctaaagattcacggtccggcacaattttttccataccaaaagctgcaatctgtaatttaggctgggaagtacccatatccgcatttccttcattggtacataccacaatctcaccagtagaagctacagcaaagttagcacctgtcatagccgcctcagcatgaataaatttctgacggagattcttccgggctgcatgtgtaaggtaagtagggtcaaaatttcctttctccgtacccatctctcgctcgaaaagctcacctacctgttcacgtttgatatgaatagcgggtaatacaatatggcttggcttcagatgcatcaattgcaagatacgctctcccaagtcactttctaccacttcaattcctttgttttccaaaaaagggttgagttcgcattcctcggccaacatggatttgctttttataaaatgcttcactccgtgctggttcagaatattgtagacaatattacaatactcatccgcgtcctttgcccaatagacatgggctccattagcacgcgcattgttttcaaactccaccaataattcatccaaatggctgttactatatagtttagtagcacatgccatattacgcaattcctcccattcgggaacttctttactcagtctgtcacgctttgccctaaccagccaaagtgtttcgtcatgccatgcggcctgtttcttgtttttcagaaactccgcagccgcttttgaatgtttcgtactcataatcctgccgctaagatttcaacaatgtgcaatgtcttgataggaagtttgtcacgggcaatgatgccattctgatgcatcaggcacgaactgtcggcccccacaatgtattcagcaccggtagcgatatgacgcatcaccttgtcatgccccatctgcacggaaaccgcatcttcctctacggcaaacataccgccgaaaccgcaacattcgtctttacgttccggttccacaacttccactccttctaccaaagagagcaaatcacgcagtttgctgaaataaggaatattaagttcgctggcagaagaaagtttcatcaatctcactccatgacaactgttttgcagactcactttatgtggaaacttggctttcaacgaagaaggtctgacgatatcatgaataaactcacagatatcatatatcttaccttcgctggcgcaccgatgtttgtcttctttcaacaaacgactgtagttatcacgcacaaaaacgacgcaactggccgaaggacctactatataatcgtaattcttaaactgttcgtcaaaatggcgggctaaatctaccgctttattctcgaaacctgcattcgccatcggttgaccgcaacaagtctggttgagaggataatccacgtccactcccagacttttcagcagcttgtacgaggctatccccacctgcggatataccgcattgatataacaaggaataaataaacctactttcattgtcattagttaatatgtgtcctatactgaataacaaagttagaggatatttgttaagaaaacaacgagatttctaacgaataatgaagcggaataggtaaaaaaacataatattgtgggtaaaagccttactaataaaaaagcactccccgcgaatcacttcgcagggagtgcttttaactaataactaactttgtggtttacgtaatttctatatgactaacttatagtgcaaagatagaggttagaggccacatccacaatcacttcatttaggtattctatcttattccactcactatttataggtattataagttcatcttcacctcgcttagttcaaccagtttatttacgatagcgtaaatagtcaatccggcaggtgaatgtatctgtagcttgcgcgcaatattccggcggtgagttatcaccgtatgaatggagaggaacagtttttccgccgtttccttatttgtcattccacgtaccacgcaacaaataatttctttctcacgctggctcaacgtttcctgttcgccatccgtctcatccacaccaagattcatcagatctactaactttttatttaaaacttcgatgtcatcatacagcgctatactctcatcgtaacccttcaacaaatttgtatctgtgactgaacacagcaaagaaacgcacttggtagatgcctgtggatagttcgatttaaactcgtccacgttaaaccatcctccgaaagtaggatttataattagaatatccggctgatgtccctgcatacaattctgcagtccttcaagagaagttatttccaccggctgtattgtaagatcaggcatgcgcttcagcacagccacaagtccgctacgcacaatgactgacgtttcggccaccgcaacgtgcacaggttctgtccgtttcatttcccctccttttctagcctaagtacagcaggcacaaacaagtagtcctctacgcggcaatgggatgccaaatcttgttcacaactgaatatgtcgaataatacggcgttcaacaaatggttatttccttttgccggataatatttaataatgatgttttttagctcagtcagtgtcgcatctatctgatcatgcctgcgggcaaactgtgagatacggaatcctcccgtttctcgtcctgccatcagattctctacgtaggtaaacacattcatatcttcataatccatgtgtttacgcacttctccggcatactgatcaaaaaatttcaaaatgagaaatgcaacctcattttccgtggaacaatctatagcttctatcagtttacgacgtatagtaggcagacagaaatcaaggaaataatgatgtgcctgttttaaataattcatcaatgaaggcatagaaatgtccttcacatcgtcctccatccggtcgctatcttcaatcatgaagttcaccaccgcaaggaaagtacgacaatccactccattttcacggcacacctcctgtacagtcttgtctccaaaccccaacgaaagatcaaaacggctcattacctgtagcaatgtatagttatcacagataagataactcattttgtccgtcggagtatatttacttgttttatacatagttatgtttttggtttctctttatggccgcaaagttacggaaaatcactagggttatcaatcactataaataggtattttttcttgtaccccataattcccgttcaactagccaatgacagtcttctaattatacattaatatatagccgttaagataagtggcaagaatcaaccacaaaagataaggaacaaaaaggtatgccgaagatttcttcaccggataactttctatcatataataaacaacaagcacatccagcaccaaaatgtttgcaaaacctagcaacggactccggagataaaagaagaaaatgctccatgtaaaattaaacaagagctggaacccgaataatctgataatcatttgtcgtcttattgtccacatatgccaaatcaacccgatagaaattcccatgcacagatagataaggctccaagcaatgggaaaagccatatcaggtggtgtaagagaaggtttgtccaatgtaggataccagttgagtatggcctccgactgaaaataagaagcagtacagcctacaccaaaacagatgagtatggcaatcagtatggggattatttttttcataaggagaattatttctatttatactatgattaacaaaccaatctctggatttgttgcagaaacagaacacttctcccatacaggtatctaaaaaacgtgctcccattcgttcgcttacgatgggagcacttacaacacaaaaactaaactagacttaactaaactattctattaagaagtttcacaacttcccttgtctatgccgcaaatataaaaagattatttctttttagcaaaaggatatcgacaaaatatcaacttttatcgttcaaatatcaactttttcaaacagaatgactatttaagtacatctgtaactcctgtttataactatcggaaatcggaatatactccttaccgaaaacaatccgcccccggtcaaccaccttgattttactcttttgcactataaacgagcgatgtacgcgaatgaaacgactagaaggaagcttctcttccatagctttcatactgacaagtgacaagatagctttcggctcatcctccacatgtattttaatataatccttcaacccttctatatatagtattcggtctaaagcaattcggagcaatttataatcactttttacatatatacaatcatccgcctcatcagcatcaacaccattatctgccttctgtttcagttcataccattgcaccgctttattcaccgattgcaaaaaatcgacatagctgataggtttcaacaaatagtccaaggcattgactttataactatccaaggcatactgtccgaatgcagtagtaaaaataatccttgtttcgggactgaccatgcgtgaaaactccaaaccgttcaactcgggcatttgaatatcaaggaacaagacatgtacctcctcgcggagaggaatttctgtcatagcttgcaccgcgctggaatacctccctaccaaccggagaaaagaagttttttccacatagcttctcagcaattctaaagccagcggctcatcatctacaatagcacaattcagtatcataagcttttagtctgtatagttaatatagaagaatatacctgtccgttctcactgatcccttttatccattcgtaatgtcccggataaatcagttccaaccgtttgcttacctgttccagccccaccccgcttccacttttatcttgcccagacttcggatgattgctgttaaggatctcacatctcaccgtaccatccgtatgcccgaagatagaaatactgataaaactgtctaccgtggggctgatgccatgcttgaacgcattttctatcagtgatatgaaaataaggggagcgatctgcaacgcacctccggagtctacctccaaattcacacttacttctacctgctgtggcagacggatacgcatcaaagctacataattacggataaagtccaattctttttcaagtgggacaaaagtctgctgattgtcatagagcacatgccgcaacaatttgctcagttcctgtaccgcctcctgcgccttgtcactgttaaaagcaatcaaggcataaatattatttaatgtattgagcagaaaatgaggattcagctggttcttcaagtttttcagctccgcttccgtcttttgcctctcagcttctatcaaacgctcttccgcctgacgccaacgcagactggtacgaatggccgcacccaacccggcgacaaatatcatcatccccatatcccgcgcatagaatatccatcgaggtggaatatgacgcgcaaattcaggaggcggaggcgtacttatactttccagaaatacatgaagaagcacactcaggcagagtatcagcacggcattgctcagaatatacttacgcatttcatccgtgaacatatagcggggaaccagccacaagtaattgacatagaagataacgaaatagcacagaggaacacaactgtgccgcaagaattgggccaggttaaagccgcttccccggtccataaagaccaacgggaagccaaatatgagcagccaactgacgatatggatgctcagttccaaaaaacgtcgctgtgaaaataattgtttcatataggcaaagataagaaagattaggttagaaataagatttctacggctcttattctgttattcatacgttcaagtttggcttcccacagctatgggccgcgctcttcacagttatggagagcgcaacccatagttatgaggagcgctctccacaaccgtggggaggcaaacccgaacgtatgttccggcatttctctccatacagaaaaccttttccgcccttattcataacgcaaagcgtctatcgggtcaaggtctgcggccttctttgccggataccatccgaagaacacaccagtaacggtacataccagaaaggagagcaacacgctccaaggttggataaacacaggccaatgcgctattgccttaatcataaagctggctccgcaacctataatcactcctatcaagccacccgtgatactgatcaggatagcctctatcaaaaactggctcagaatatcgacccctcgtgccccgaccgacatgcgcagaccgatttcacgggtacgttctgttacagacacatacataatattcatgataccaatacctccgactaccagagagatgccggcaatacaagccagcaaagtggtcatcaggtccgttgtggtgttgagcatactgctcagttcctgctgggtgcggatggtaaagtcgtcagcgtccgtttctttcagcttatgttcacggcgcaggatggtcgttatctcatctactgcttcctcggtcatttcttctgtcagagccgaagcaaaaattccacttaggtaagtctgtgccagcagtcgtttcatcaccgtgctataaggagccagtaccacatcgtcctggtccatgcccatcgagttatacccttttgatttcagcacaccgattacccggaaaggaatctggttacaacgaatcactttccctatcggatccgatccgtcgggaaaaagattatcgacaatggtcttgccgatgacacagaccttggctgacgtacggatgtcattctcggtaaacatctccccctgttccacggtgagctggcgtatggtaagataatccatacttacaccactcaccgaagacgggtaattgttggcccccgcaacaagttgccccgaagaagaaacgttgggactgatgccggagagataagtacactcttcgctcaacttttcataattttccagtttcagtgtctgcatggccgaagggtcttggcggacccctccacgcatctctgctcccggatgaatcataatcatgtttgaccccatctccgagatttgttgctggatgctctttttcgagccctgaccgatggcaagcatagcaatgactgatgccacaccgatgatgatccccaacatggtgaggaaagcgcggagcttgttgttggcaagggcccggagagctattttaaatagatttgttccgttcataatgattcttttttatggttagtcctcgtcattcttgggcaaggcagccagtgcggcagcggccgaaaggatctgaggattgacggtgtcttccactacatgcccgtcacgcaagcggatattacggctgctatactgggctatttcgggattgtgagtgacaaaaataagcgtacggccttcggcgtgcaacttttggaaaagcaccagaatctcgaaagaggtacgggtatccagattaccggtcgcctcatcagccaaaataacggcaggattattcaccaaggcacgggcaatggccacacgttgcatctgtccgccggacatctgattggatttatgttccagacggtcacccagtcccacagctatcagtgattcaatggcacgtttccgtctttcggaagccgatacggacgagttatacatcaagggcaactccacattctctacggcagtcgtcttaggcaacagattatagttctgaaatacgaaacctattttacgattgcgcaacacagccctctgaggtttgctcatggtacgcacggacacaccatccaacaggtattcaccactggtaggggtatcaagacatcccaaagtattcagcagagtggacttgccggaaccggaagtacccatgatcgtaacaaactctccctcgtagatggtaaaagagatgccacgcagggcgtggacggtttcatcgcctacctggaagttccgttttatattttgtaattcgattatctttttcatgtgatttattctttcaatgtaaacggaagcattaccttttattacttgttctttttcttattgcttcccggagggcctggcatgaacggacttctttcaccttctccggcagacggttcttccattccaggcatagcacctttcactaccgtttctgtcactaccggtgtattttcagtgatgccactcacaatctctgtcttgctgccatcagtaatacctatttttacaggatgggcggtaaaggtattgttatccagtgtccacactttatgactgctctggcaatcgtttatcttacggcctcccactatgtccttgttgggagtaaagcgcaaagccttgttgggaacggtcaacacattatccttggtcaatgtataaatggtagcgttggcggtaagacgcggtttcagtttcaaatcgggattatcagctgttatcactacctcataagtaactacagtggtgctggtggttgttgaagagctgctgctcgtgctgttcgtgctccccaaacgaatctgtctgactactccttcgaacacatcgtcgggataagcatccacggtaaaggttacacgggctccttcctccaccccggcaatatcggcttcatccacatcggccaccacttgcatcttggtcaagtcggcagcgatggtgaacagtgtcggagtctcgaaaccggatgctacggtctgtccttcttccacatcacggctggtcaccactccatcaatgggcgaggtgatggttgcgtatgacaggttacgctcagcctttgccagagccgccttgctttgctccaatgcactttgggcacgttggaaattataaaccgtttcttcataatccgtatcgctgattaattgcttctcgtgcagcttacggttacggtcgtataatttcttctgatagtcgtactctgccttattgccgtcataggtggcctttgccgactgaagttcactttgcaatgtcactttatccatctcggctatcaattctcctttctttaccacggagttgtaatccacataaatcttatcaatgataccggatacctgcgtacccacttccacctctgtcaccggctctatggttccggtagcagtgatgaaattgctgacattgcctttcgttacagcttccgttgcgaaatcgaccgtacttttcccctccggtccgccaagcatccagaaaccgcctgccacgaccactacggctaccgctgtagtgaggataattttcttcttttccataatataatatgtatagcgttatgattataattttatatcctgacctgcatagaagttcagtaaagtccggtccaggatagccatatatttggcctggatacgttgctgctgtgcactgagcaggttatttttctcggtaagcaactctacggtattcttcattcccaaattgaactgctcgctgaccatctcgtaactggcctggctacttttcagtttgctttcggccgccgcatattgctcttgagcgttagtagcgtccagccacagactttctatattcttatagagttccttttgcttgtttatcaaatcgagcagactactgtcatattgcaagcgtgccttctgtacggcacttttattctggcggttatcaaaaatcgggatgtttatgttcacccctatcatattgttccagccatacttcatttgtttgctccagctattgtcactggcactgtttgtcatactccccgtagatgcactcagactgatggtagggagatagccggctttagccactgatatatccagtttggaattctcgatgctcaacttgctgctttggatttccggacgtgatgccaaagcctgctgataaacatcctcctgagcaggcagcggttgcaagacatgctcatcggccagttcgggaagaaccaaatccatttcttccgtaccgtccagttccaacaactgcttcaactgcaatttatagtcgcgcaaagaactttcagaggtcaccaactgatatttgtcactgcttacctgtgattccagctgcgccaaatcggccttcgaaatactcccttcctgaaagagctctttgcccctgtcgtatgtggcctggctcacctgtaaggtattccggttaatcttcaccgactcgtcggcataaagtatctggatgaaaatttgtgcaatctgctcttgcagagagttctccgtttcggttacggcaagccctgctatctgctgactagttctcctctgcttgatcgtattcaagcgtttgttaccgttccacaaggtccactgcgcgttcagaccatagtttccattataagtggttttactatcactactgatgatctccgttccgcttaccgtgttactggtttcctgatacggacggttcgtcacattctgtcctgtgctgaacgacagactgggaaagagggcggctttggcggttttcacgtctaccgagctctcttccaatgagattttatcctgctgcaattggatatttttctccaatgcatagtcaatgcagtcgtccagcgtccattttttggcttcttgggcggaaaccgaagtaaccgcggccaaaatcattgcgaaatatactactcgttgtctcatcctttttactatttaatttgttgatacaaaagtagaggaccgtgatatttttagcaataaatatagatttgcggaagatttctatggacaaaaacttgctttttaccgataaagtgtttttctttgtaattattacaactttaagataaatttatgaatgattctttgttaacacgcatctggatattctatcgcgacggctttcgcgagatgaccttgggacgtaccctctgggcgattattcttatcaaattattcatcatgttctttattctgaaacttttctttttcccctccttccttggcggcaagacaacggaagagaaacaacagtatgtaggtgaagagttaatagaacgggcaaatccataaacatttaaataaatcagaaagttatgtttgaaaacattgacacttcgttaattgactggtcaagagcgcagtttgctttgacggccatgtatcactggcttttcgtgcctctcactttgggattggctgtgataatgggactcatggagaccttttatgtgacaacaggtaaggaattctggaagaacacagccaagttctggatgaaactgtttggaatcaatttcgccgtaggtgtcgccaccggtctgattctggaatttgagttcggaaccaactggagtaactattcctggtttgtgggagatattttcggagccccactggccatcgaaggaatcctggcattttttatggaagccactttcattgccgttatgttcttcggctggaacaaagtgagcaagcgtttccacctggcatccacctggctcaccggactgggagcaacgatctccgcctggtggattctggtcgccaatgcctggatgcaatatcctgtagggatggctttcaatcccgaaacagtaagaaatgaaatggtggactttgcagctgtcgccctctctcccatggctgtcgccaagttcttccacacagtgttaagcagctggatactgggagccgtttttgtagtaggaataagttgttggtatttactgcgcaaccgtcagaaggagttcgctctgagcagcattaaagttgccgccgccgtaggtctgttcgcttccctcgtcactgcatggacgggtgatatttcgggagtacaggtagccaaagtgcagcctatgaaaatggccgccgccgaaggattacacgatggtggaaacggagtgcccttcaccattgtaggagatttgaaaatccccaaaatgctttccattcttgccactcacgacatagacggctatgtaccgggtatcaacaatctgctggaaggtggttatcagatgcccgacggtacaacggctttatcggccgaagagaaaattaaacgcggacagattgccatcgccgctctggatgcattccgcaaagcgcataaggcaggtgacgaagcaagcgccgccgtagctcgcaagacattggacgaaaacgtgaaatattttggttacggatatatcaaggaccccacccatctggttcctaatgtggaacttactttctggtcattccggatcatggtgggactgggaggttatttcatcctgttctttatcatcgtattgattgcatcgaaaaaagagaaactggccgatatgcgatggctgcaacgggtggctttgtggactattccgttagcctacatcggtagtcaggcaggctgggtggtagccgaggtagggcgccagccatgggctatacaggatatgctgcccgtaggagcagccatctccaagttacagacagggtctgtacaacttactttctttattttccttctgttgttcaccgttctgctctttgcagaaataggtattatgctgaaggctatcaagaaagggccggagggaatcaagaattgagaactaaggtttcttcagttctatctttcaatattcaattctccatttttaaattagaacattatggactatatatttttacaaaattattggtggttcctggtatcgttactgggagccctgttggtgttcctgctctttgtacagggtggtaattccttattgttcacgctgggacgcaatgacgaagaacgtgccttgctggtaaactccacaggacgcaagtgggagtttacttttaccactttagttactttcgggggcgctttcttcgcttctttcccgctgttctacagtaccagcttcggcggtgcttactggttgtggatgattattcttttcagtttcgtattgcaggctgtctcatacgagttccaatccaagctgggcaatctgctgggcaaacgcacttaccaatggtttctggttataaatggcattgtgggtccgttgttgctgggaggagccgtggctactttctttaccggctccaatttcctggttaataaaggcaacatgggcaatgaactgatgcctgtcatcagcagttgggccaacggatggcacggactggatgcgctgactaatccttggaatctggtcttgggattcgccgtattcttcctggcccgtcttttgggtaatctttattttatcaataacatccgggataaagacttgattccccgttgccgccgtcagcttataaccgatgcgattcctttccttatcctgtttctggctttcgttatccgcactttattagccgacggtttcgctgtaaatcccgaaacaaaggaaatttatatggaaccttacaagtatttcctcaatctgatggatatacccctattgctggtattgttcctcatcggagtggtcggggttctttggggcattggaaaagctgtattcagcaagactgccaccaatggtatctggtttgccggtcccggtgtcgtgctcactgtattagctttattactttgcgcaggatataataatacagcttactacccgtctacagccgatttacaaagttcgctgactttggccaacagttgctccagcgagtttaccctacgcaccatggcatacgtttccattctggtacctttcgttctggcctatatcatttatgcttggcgtgccatagaccgcaagcccattaccgcaaaggaactggaacaagacggacacgcttattaaagagtcttaatggattatagtgaaggcatcctgttttgcaaatagctgtaaacaggatgcctttctatgttaaataacattgtttcaacctataaaatgaagagaatatcttgcaaatttccgaaatatccgtacctttgcattgtgtttttcatagtattagatttaaggttaacaaaggttggagcaaggcgttgctcctttttttatatctataggacacatagcgtccatagttgattcatttcccatctagaaagttattttcgtttaaactcttcatctcaaagaaatattatgatacaagtgatgcatacagttgcggattacgtgcatgatgccagatataggatgccggatagacctcttctttatttttatcaaggatttctttcagaatactgcatttgttctcgcccgtcaccagaaaacaggtatgccgggcttctatcaaaggacgtcccgtcatgcatatacgcactgttttattataaggattgacggacacctcatacggttccccggcggtaagaagttcctgacgatcggggaaaatggatgatgtatgcccgtcctctcctatccctaataatacaaaatcaaaaacaggcacaccgtccatggtcggaacggtggtcttgactatggaagaatactgtttggcttcttcttcgggagtgccctcacccacaatacggtagtaatgactggcaggaatacctaccttgccaagcagcagacgatgggccaggccaaagttgctctgatcatcgccaggtggcacgcaacgctcgtccacccaatagaaataaatacggggccaaggggtatatgcggcatattcacgctcccaaacctcaaaaagtgtggcaggagtagttcctccggaaagagcaatggtaaaaggccgttcaggctctttatccatcgcttccaatatatgagttatcaaggcttgcgacgcttgtacaggcgacgcatacaagttatggtcaatcatcttattcactatttattactcagagtttgctgtttaaatttactattcacagatgacgacttacaatttacagtataaattggaatgtgtcagattcttgcacgggtttgtccattcggcatgactgcggttgatcaacacatccgcttctttcggtccccatgttcctgcaggatacccataaagaggagtttcgggatgcttcttccaataatccagaatcttgtcaaagtaagtccagctctcgtccacggcatcggaacgggtaaaaagtgtaggatcacccgccagactgtcttccaacaggcgtacgtacgcatcccccgtttcctgatcgtgctggtcatagctgaaatccatctccatggttcccatatagaaaccggcaccaggttctttcatggctatgcgctgaagaattccctcgtcgggctgaatacggataatcagttcctcacctttatacaagccctccttcatttgaaacatctgcataggggccggtttgaaatgaatcacaatttcggtcaccttggtaggcatctgcttgccggtacggatataaaaaggtactccctgccaacgccagttgtccacatacaggcacatcgccacgtaggtatccgtacgggaatcaggatgaacattcttttcttcacgataaccgatacggtcgtcaccggcaatatattgtccgcggacaacgttatcacggatatactcatcagtcagcggacgaagggactgatagactttgatcacctcgttacgaaaaccattcttgtcaaacttggcaggcggttccatggcagtaatggcaagcaactgcatcaggtggttctgtaccatatcacgcagagctcccgctccgtcataataccctccgcgagtacctatacccatattttccaccgcagtgatttccacatgatctatatagttacggttccatatcggttcgtaaatggtacttccaaaacgggtcaccataatattctgtaccgtttccttgcctaggaaatgatcgatacggtaaatatcctcttctttaaaataagcggcatagatcttattcagtttctgagcagaagcaaggtcgtatccaaaaggcttctcgacaatgatacgctttaatccgggctttttcagcaagcccgcatcatgcagatatttcggaatcagttcataaagcaatggcggagtggccaggtagaataaataattcccattattctcatattgaggtgaaagctccttcagacggtcattcagcagagaataagtggtttcgtccgccgggtccatggactgataatggacagtagagagaaaatcgtccaatgtttccatctcttcttttgtaagagaaccggactttatcagttcttctttcagataagcacgataggtttcgtccgtatatgcagtacgggcacagccgataatggcaaaatgctcggggaagcgtttcccgttatgtatctttatcagggcaggcatcagtttgcgccgggttaaatcaccggatgcaccgaagatgaccaaaaataaactatgtggtaaactcatgattctttcttttaaaaatgaatgtataatgctttgtgttgcgacgtatcaatagttgtcttcccaatgttcgtggaaaaattccccccgtggactgtccacacgctcgaaggtatgagctccgaaataatcacgcatcgcctggatcatattggccggggaatggttggtggtcagacccagaaaataattcaacgctgcggaaagtacaggtacgggcaatccttctttcaacatgacaccgatgtatttcttccacgcgggcagggcttccgttacttcccgtccgaaatgctcgtccagcaacagatgcgacaatcccggcgcacggcgataggcctcggcaatgtcgttcaagaaagcggaacggataatgcatccggcacgccacaacagggcgatggtggaaagattcaatttccagccatattgttcactggcagtgcgcatcagagcaaacccttgcgcataacctatcagacgggcggcatacaaggtactctccaatccggccaccgtatcctgataattatataccggatgattctccacatgcatataatgctgggacatcagcacacgcaagttcttctccgccgacagattacgggcaaaaacagcctcggcaatcacgtccagcggcgtattgagttgcagagagttaatgacactccaacgacccgttcctttttgtccggcagcatccagaatgttgtcgagcaaataaccgcctccttgttctttatgacgcagaatggctgaagtaatctctatcaggtaactgtgcaggtgtcctttgttccattgttcaaaaatatccgccatctgttcgttcttcaatgccagcagatgcttcatggcgaaataagtttcagctatcaactgcatatccccatattctatgccattgtgcaccatcttcacatagtggcctgccccaccgggccccacccattcgcaacacggagtgccgtcctcggcttttgccgcaatacttttcagcatcggctgaatgaccggccatgcctcttgcgcaccaccaggcatgatagacgctccatgcagagcaccctcctcacctcctgagataccgcaacctacaaagtacattcctttatcataaagttccttcacacgacgttccgtatcttcataataagagttccctccatcaatgaggatatcgcccttatccagtaaaggaagcagcttacccatcagttcatcgacagccggacctgcctgtaccatcaagaggatgacacgcggagctttcagcgcttcgacaaaatccgtcagttcattactgcctatgataccttttcctttggcacggtttgctataaagttatctactacattttcttcttttccgggaacggtacggttccatactacgaccttccatcccttgtcagcgagattcagagcaaggttctgccccatcacgcctaatccgattaatcctatatctgccttttccataaattgttctttttatatttaacaatttaataggtaatttgttcaataattctatctttgcaatttgaacaatagcacattatcatgaagaggttaaaaatcggcttattagcccggattatcatcgccatcgcattgggtataggattcggaaacgttcttcccggcgaactggtgagagtatttgtgactttcaacgggatcttcagcgagttcctgggtttcatcattccgttgattattctcgggctggtcactcccgccattgccgatatcggcaaggaggcgggaaagatgctggtaatcacaacgttggtggcatacggcgccactttgttctccggattcctgtcttatttcaccggagtgactttattcccttccatgattgctccgggagcgccgatagaacaaatcagtgaagcgcatgacatttctccgttcttcaccgtaggcattcctccggtgatgaatgtgatgacttccttgatcctggccttcacgctaggtctgggcatcgcacatctggatagtacagcgctgaaaaacgtatgtaacgatttcaaagaaatcatagtcaagaccatccagacggtgattctgcccctgctgcctatctatatattcggtatattcctgaatatgactcattccggacaggtatataacattctgatggtattcattaaaattatcggagtaattttcctgcttcacatcttcctgctggtttttcaatataccattgcagcgctgtttgtgcaccggaacccgttcaaactactgggaaagatgatgcctgcctatttcacagcattgggcacacagtcatcggcggccaccattccggtgactttgcggcagaccatcaagaatggggttacggaggatatagccggatttgtcattccgctatgcgccacaattcatctgtcgggaagcacactgaagattgtcgcttgcgcactggcactgatgattatgcaaggaatgccttttgatttccccatgtttgcaggatttatctttatgctgggaattacaatggtagccgcacctggagtaccgggaggagccatcatggctgcattggggatcctgtcttccatgctgggattcggagaaagtgaacaggctttgatgatagcactttacattgccatggatagtttcggcactgcttgcaatgtgacgggcgatggggctatcgcattgattattgataagtttttcgggaagaaaaaccaccggtctatacaatagaaaaagcattatcgaactaaataaggccagaaagaaaaagatatttttagaaacagggcagtaacaagttgacattttttcattatctttgtttctataaaatagagaaaggagaaaaatcatgcgaagaaccgaaattgtagatatgatacgcagtatcctccacaaagtagcaccaaatgcccaaatcatactttatggatcggaagctcgcggagaggctcgcccagacagtgatatcgatctgcttattcttgtagatgagccacagcttactccagaatacgagcaggaaattatccgtccgctttatgaactggaagtaaaatcgggagttattatcagcccaatgattatgctgcgcagattatgggagaaccgtccctttcagactccgttttcgctgaacgtaatgaatgaagggatagtgttatgaagcaggaactatcccccgagcaccgcgttgccttgattcaataccgttttgaacgagcgtataagactttggaagaagctgactatatgcgtgtgggaaattattttaacgccgccatcaaccgcctttattatgcctgcttttatgcagccaccggtttgttaatagctaagggaatcgaggcaggcacccacaatggagtaaaaacaatgttgtcctatcactttgtgcgcacaggagtactgagtctggaacatggcagcacattcagcaacttgtttgacaaacggcacagtggagactacgaagactttgcctattgcgatgccgcattggtagattatctcagaccacgtgccgaagctttcatcaaatcggtagaaagtctggctcaagaataaattgatcgctcccaaacaaaaacaaacatattctttctgcccttctatcgtcttcatcctgccattacgctatctccaagaggaggtaacgcaatgcagaataacaaacaaaaaaggaaaacatgagctagaatacaggcatctgccaaatgaatcccactgacacacgatgggtactgaaattgtcctcacccaatgccttcgcacgatcggtatatttataggaacgccccacgtatgccaggaagaagtgcagattgctctccatcggataaaattctattcctcctgcatatccccatgccgtgcgatatttacctttttccacttcatcgcttgccttataaacggaagccgtttcatacattccttttgcaaacaagttccacttcggggcaaaacgataattcacatgcaacacataggacatatattcggcattaaaagcattgtgtgcctgattatcagttcctactatactagttataatccctttacggtctaccccttcatgagaatacatccagtcaaaataggcgtgccatttagggctgaaattaaactcattacccaaagcataataatacatcttctcgcctttcgtttcgttcatgacagaggcagaccaacgggttttgaaaacatccagaaaattaccattccagttcaaggtataaaccaacggcagtttggtacgttccaaatccccgtacatctcctcggacggcccgttcagactgttcaatacctgaaattgtatctgctgataaggattatagttgtatgccacattcaaaccggtcatgaagttactcatgtgctctatcatgtcactatattcgtaaatatcaatcggattcaaatcaaattctataccaccatacgaggcacattgctttccggcaaaaaatgagaacttatttaatttgatgcctactcccgcccaatctatgctggtaggtacattatctatattgccggaaccatcgttaccccgattcagacgctgacggtaacgatagctcaaccagtcattgatatctcccttcatctcgatacggagttgcttcatttcgaatgcgccccgatcaaatccggagtcgttccatttcatattgaaatcaccgtgcatattaagatagagattgaacttgtccgttttcttcttgataccggtgacttcttcaaacaggcttttgtcaccggccatgaaatcacttccggaagattgggcatataaagggtaagtgcctgagacagcaagggctgtcaggcatactaacattattcttttcataagtcaaagttttaggttgtaatgtattctctttttcttttatgcgcacaaaagaaaaagagataaaaagaaaaagtgccggatggactagtatacgttgaagtattcctgaattttcttccagtcttttgtcttagtcaacgccagcatcaacaacacacgtgccttctgagggttcaactcctgtgaggccacaaattggtatttattatcatccacctcagcatccaaggtagtcggtccggtaggaacacggctggaacgcactaccaaaataccttgttgacgggccttttccaacatcggaaacaaattctgatgaatgttgccattccccacaccggcatgaacaataccctgatacccattattcaagaaaggagtcatgatatcagcttctacattggaataactgtaaacgatacctactttcggcaacttgtcaaggtgggttacatcaaaatcggaaccggtggtatggcgtttcaaagattccatattatagaaaaccttaccattcaatacatatcccaacgcaccggagttaggggactggaaagtctgtacatccaccgtattggtcttcatggctccgtgagctcccaaaatcaaaccattcatagcaattacgacaccttttccccgtgattccctggcggcggcagtgactactgcattatacaagttcagcggtccgtccgcactcatggccgtagaggggcgcatggctcctaccaatacaacaggcttgtcactcttcacagtcaagttcaggaaaaaggcggtttcttccatcgtgtcagtcccgtgggtaatcacgataccgtccacatctccacggctgaaaagctcgttgatacgcttggccaacgtcagccatacggcatcattcatgtcctgagagccgatttttacaatctgttccccggtcacattggctattttgttcacttcgggaaccgcttccagcaatgtgctgatagccacctgtccggcagtataatttgttttagtagccgaagcgcctgttccggcaatagtccctcctgtagccaatatatggatattaggcttttgggcgacagcagccaatgtggtacataccagcattgccgccataaggctgagttttcttaatccgttcataatcttttcaagtttaggttttattactataataattatttggaaattttgttcacacacagaggaagaagatgcgccgatgatatatatgtgcacatcgaatcattataaatgttacaggcagaagattactcatgttacagatgaaagattactcatcttcaagcctgaccgcacctatccctttcctttctagaatacctgtatcagcagcaggcctaccacaatagaaacaagggtagccaccattccgggcatcataaacgaatggttcagaatccattttccaatacccgttgttcctgtacggtcaaagttgatggctgccaccaccgtaggataattagggataaagaaatatccgttgacggcagggaacaaagcaatcagcatcatcggagaaatacccagtgctattcctaacggtacaatagcacgcaccgtagcagcctggctataaagtaaaatagacatgacaaacaatgccagaccgaacagccagggcatttgacgcacaatcccttcaatagaacctgtcagttccgtaatgtttccattgatgaacgtatcccccatccatgcaataccaaaaatagcgattaccgcctgcattccggcaggaaacacgctgccttgtgtagccttgattccatccgtacgtgaaatgataagaataatagctgccgcacacaacatcaagatctcaataatagaaggcatatccaaagccgcaccgttgaacacaggacgcatagcagggatagagccgaataatacaatcagcagtgtggcggcaataaagataatcaccgagatacgggcgtgaaacatattcttcacatcgttcagttccacatgttttgtatcaatcattccggcttccagacggcgcaggtattcaggatcttccaacaactccttgccgaccttttttgaaaggaaagcaccgaccagcacaccgattaatgtagcaggaatggtaatcttcagaatatcaaacaaagtaatgtcaaatcctgtcagcaggcccagcaacgctacggtagcggcagagatagggctggcggtaatagcctgttgcgaggcgataacggcaatgcctaaaggacgctcaggacgaattttagtttccgtagctacctcggctatgacaggaagcacagagtaggccacatgccctgtacctgcgacaaaagtaaacagataagtaaccaacgggctcaggatagtcacctgcgaagggttacggcgcaacagccgttccgccaacttcaccatatagtccagtccgccggcagcctgcatacaagaggcggcagagataacggcgacaatcatcaacatcacatcaatagggggagcggtaggctgaagtccgaagacaaaagtcaatatggcaaggcctacacctcccatcactcccaatccgatacctcccaaacgggcacctacaataatagcgacaagtacaaatagcaattgcaataacatggtttttatccgtttataaatatacaattttaattccgagaacaaagatagaccatttctgttctacaaaccttaaaatttctaagaatttttccttttttcactactttccccctaaaacattcaataaaagttagttgttttgtataatgaataatgtgcaaattattaaattattatatatgaacagaatttgcaacctttttggaataaagtatcccatcatacagggaggaatggtatggtgtagcggttggagactggcctccgcagtaagtaatgccggagggctgggactgataggagcaggctccatgcatcccgaaaccttgcgcgagcacatacggaaatgcaaagcggcgacagacaagcctttcggagtaaacattccgctgatgtatcccgaaatagacatccttatcaatatggtaatagaagagggtgtgagaatcgtcttcacctctgccggaaatccaaagacttggacagaacacctgcatgagcacggcatcattgtggcccatgtagtggcaagcaccaagtttgccgccaaatgcgaagaagcaggcgtagacgccatcgtagccgaaggattcgaagcaggaggacataacggacgggaggaaacgaccaccctatgtcttattccagccgtcagacagattaccactgtgccgttgatggctgccggaggtatcggatcgggagaaagtatactagccgctatggcattgggggccgacggagtgcagataggcacgcgcttcgcattaaccgaagagagttccgctcatttcacattcaaagaccgatgcctgcgactgaacgaaggagatacccaactgacattgaaacagctctctcccgtccggctggtcaaaaatgatttcttcaaacaagtggaagaagcggaaagccgtggcgcgacaacggatgaactacgcactttgttaggaaaaggacgtgcaaaaaagggaatctttgaaggagatttattcgaaggggaactggaaataggacaagtcgcatcctgcatacataaattacagacggtggatgaagtgatgaaagaactggtggaagatttcaatgccgcattaaacagggtcaatgagttgcaaagatttatctgataagaaggacgataaaacaatcaaaaaaccggagaatgaatcaaaaacaagatgaacattctaaagattacagattgtaaccgacaaatacataaaagtggatgtgtccaaattcagtttttggaaatatgaacttataatctgagatttgagcatcctaaaagactaagaaagggtcgtatcattactcaatacagagcttgatacgacccttttaagtgttataattactatctgtaaccattaggagcagtcattttggttttgacacgcctaatgcataaaattaagttattctacttacaccttctcttattaaacaaattagcactcaggaatcccaccaaaaatatcagcaacgttccgaatacgatagccagattggcatgtacaaaaggggatatcacaatccaacaaaccagaattaccccacaaacgactcccagtaccgcatcaaaattacgtgccttcctcgaaatataccccaatagaaacagtcccaacatgcctccgctgaaaatagacgccaacgcccaccaagcatccagcgcactttgcacactcataaaggcaaaggccaccagaattcctgccactcctactcccacactagagagtttcagcaccaacatccgttccctgtttccggcatgtttgcggaaacgctgataataatccgtcagaatgatggtagacgaactagtgacactggtcgcaatggtactcatacctgcggcaaagatagaagcaatcagcaggcctgtcaaccccaccggcaactcattgactataaagaacggaaagacataatccgcccccactccgtcgggcaagacccccggatgcactttatagaacgcatacagcccggtccctatcataaagaagacagccgaaacgggaataaacaaatatcctccgaacaaggccgagaacttagcctccttctcattcttcgccgtatgataacgttgcacataactctggtctataccatagttctgcaaattggtaaatacgccataaatcaggcacacccaaaaagtggactcacttaaactgcttccaaaacttcccaagctgaattttccatcttccatagcgatggagaaagtctgtgccggaccttcgggcatgtcaaaaagcaagataaacatacataccagcgcaccgccaatcagaataatcccctgtatggcctctgtccaaatgacagctttcatgccgcccagcatggaataaagtacaatagccacactggtcacaataatgatggtctggatattccatcccagcaatacattcatgggcaatgccaacaaatacagaatagagcctgtacgtgcaatctgggtaagcagataacaggacgaggcatatatacgggcccaagggccgaagcggttttccaggaaactataagccgatatactgtcctggcttcggtaaaaaggcacgaagtaacgagccgcaaaataagaagctatagggatagacaggctgaatacaaacgcattccaatctcccgaaaaagcctttcccggatatcccaaataactgatactgctgacatacgtggcaaagatggacatccccaccacccagccgggcaagcttctgccggcagaagtgaactcctcggaagtacctttcttcttaaagaaagaacaaccgaaggccacgactccgccggtaaacagcaaaaagacgattatatcaatgatatgcatacagaccgagcatttaaggtttcaactccggacaaaaagggagtgcctccaacgccttgcgtatcttctcgcgttccggagcattgaagcgatggaaaggagccgcaacaaaatcatcacaaacgcccaataaagacaacgcgcatttcaatcccttcagataactggaaccatgctggcccacagtataaatactgctgcttatctgcatcaccaggggttgaagacggctcaccgtttccatgtcacgtgccaaggcggcattatacaggtctacatacaattccggaaacatattggcacctccattgatgcctccgtgtccacccagtaacacacactcggccgtaatttcctccggtcccaccagcatggcaaaatccggtcggtccttcatggcatacatcacggactggaaataaacggcattggccgaactatccttgaatcccactacctgagggttacgggcaatgcactgtatcgtagccggagcaaaattcacttttgtatgcgacggcatattatataagaagataggcaacggcaactgagggataaggtcttcataaaattcggccagttcaggctgccccggagcaaaatagtaagggggagcggaaactacggctgaagcaccacactcggcccccacatgtgccagatgaatactttctacaattgatgtatcggaaatacaaaccagaaccggaagtcttccggcattgatacggcaagtttcctttatcatttcatggcggagccggtaactgatgctctgcgcctctccagtggtacccagtataaataatccgtgcactcctccttttatcagtcgttctatcaatctttccaaaccgtcaatatccagtttgtcattatccagtaacggagtcactaaaggaggaataatgcctgtcataggcttttttaatgtgttttccatgattcgttttctttaaaaaatttcaatgctatatttatgaaacgaacagtagaattatttgtactcagtccaacaccccggcttgtccggaaagcgacagggcactatcgtttaacctgtcgtcttccgtctgcccggaacgtaccttttgaaaaagaacttttaattccgcttcaagaaaagagagttagttatacatgcgggcaactcttcctgataatgtgtcaccataatcatggtcttgtccttacgacggcagaaagtttctatcacatctttcaccaaccggcggttgtacaagtccaacccatgcaaaggctcgtccaaaataagcaactcaggatccttcacaaaagcacgagccaacaacaccagacgctgctcgccactggacaactgcaagaaattccggtctttcaaatttgcaataccaaaaatatccatccaccattcacaagccgccatctgctcgggacgcggacgtttgtacaaccccacagaatcatgtagcccgcttgccacaatatctatggcaggaaggttcttcagataagcgcgatgcatctcaggactgacatatcctatatgcttctttatctcccaaatactttctccggaaccgcgttttctgccgaacaaggtaatatcacaagcataactctgcggattatctgcacagaccagactcagcaacgtagactttcctgaaccgttctctccactcaaagcccatttctcgccacatttcactgtccagtccaaatctttcaaaatggtacgctcgccataacggatgcttaccttgttcaaatcgactacgtgctcggtgtgatacaaatcaccgccgtaaggcaaattcagaatccgtgcctccttttcttcggaaagcatccgttccggtatcgacttacggaccgccaaatattcctgcaaagtcatctttttaccacacaccctgtcttccacaggaataacatgagtgataaaagcaggaatatcatcggacttagacaagataaggattacctgcaaatgggttactttagtcagttcacccaacaatgtatgaagcaggtccctcgtcttcgcatccagtccgataaagggattatccataatcagtacacgcggattactcagcaaagtctttgtcagttgaaacttacgtaactcaccactggaaagcagaatgatatgtttatccagcatcctctccatgccaaacagttcatacaaagccttttccaggcctgaatcggtcgcttcgggcaacaaatcacgtaccagtggagtttcatccaaatcatgagcattccaccgttgctgataatagtaatttccatcggcatctccgtatgaatcacggaaagcaatatactttatattctcgtatgccatcttcgaaggagagggagagaaatcatatttcacttcgttcatcaacaacggccaccgacctgtaatcgtatctaccaatatactttttcctgccccgtttcttcccacaacagctatatgttctccggcggcaagtgtcatattcaccggttccttcatccggtacagcggatggcgggtcacaccattttctatcgcaataatattctgcattacaaatctcttttttacccaacaggatgcaaaggtaacaaaataatatagcaatacgataatatattatcattttgttacatcgatcatccaccttaattatatacgataccgattatacaacactgaataaccaacaaaatattacctaaactatatgttccataacagagtacagacttaatgaattacaattaaaaagaatataactagacttttatttcagtttgaaagaaaaacacctaaaatagctttctatttatcattagaataaaaataaataagaatatagatagcaccattgtttataaaacatcaaaaagatatatatttgcaccaaaataagacaaaaggaaataataacagaagaagttatagacaaaatggcaacaacaatcaagttcacgaagatgcagggagcaggtaatgactatatatacgtaaacaccctgagacaccccatagcagaccccgtgagaacttccatcaaatggagttcttgtcacacggggatcggttccgacgggctggtattgattggaaaatcaaccaaagcggatttcagtatgcgcatattcaatgcagatggttctgaagctatgatgtgtggcaacgcctccagatgtataggaaagtatgtatatgacaacaaattgactcaaaaggaagtcatcacgctggaaacgctctcaggaatcaagatcctaaaactgcatacggagaacgggctggtagaagaagtaacagtagacatggatcttcccctgcttaccaactccagacaaataaataccccggacggcaaaatgttggcaaaaacaatcacagtagatggaaaagaatacaaaggaacatttgtttgtatgggaaatccacatttagtaattttcatagatgatataaaaaatgtaaatttgccggcaataggtccgaaactggagaatcatccgctttttcccgaacgaacaaatgtagaattcgttgaagtattgccggacggttccttaaggatgagagtctgggaaagaggctcgggcatcaccatggcatgcggaacaggagcttgtgccactgccgtagccgcatacctgaaccacaaggccggaagaaaatcacgggtaaggatggatggtggtgatttacaagtccattggaacgaaacagacggacatgtgtacatgacaggtcccgcagtaaaagttttcgatggtgagatagaaatttaacaggaataagaaatcagtaaagacaaactataaaacaacagcaattatggcattagtaaacgaacattttttaaaactgcccaacaattacctgttttcggacattgccaagaaagtaaatgcattcaaagtttcccatccccaaaaagacctcatccgtctgggcatcggagacgtgacacaaccattgccccaagcatccatagaagccatgcacaaagcagtggacgaactggcaagcaaagaaaccttccgtggatacggtcccgagcaaggatatgattttctaatcgacgccatcttgaaaaacgattatgcctcacgcggagtacatttggaatccggcgagatattcgtcagtgacggcgccaaaagcgatacgggaaatataggggacatcctccgccacgataacagcatcggtgtgacagaccctatttatccggtatatatcgactctaacgtcatgtgcggacgagcaggagtgctggaaaacggaagatggagcaacgtggtctatctgccctgcctgagtgaaaacaatttcattcccgctatccccgaccgcagaatagacattttatatctatgttaccccaacaaccccaccggtacggttatcagtaaagcagaattgaagaaatgggtgaattacgcactggagaacgacacattgattctttatgacgcagcctacgaagcctacattcaagaccccgacatcccccactccatttacgagataaaaggagccaaaaaggtagccatagagttccgcagcttctccaaaaccgccggctttaccggagtgcgttgcggctacaccgtagtacccaaggagctgaccgccgccacattggaaggaaaacgcatcccgctgaaccggttgtggaaccgtcgccaatgcactaagttcaacggaacctcgtacattacccagcgcggtgcggaggccatttacagccctgaaggaaaggaacagataaaagccaccatccactattatatgaccaacgcccgcatcatgaaagaaggactggaaagcaccggactaaaagtattcggcggtgagaacgcaccttatttatgggtgaaggctccccgaggaatcagctcgtggaagttctttgaacaaatgctgtacgaagccaatgtggtaggtactcccggagtaggattcggtcccagtggagaaggttacatacggctgaccgccttcggcgaacgcgcggactgtgaagaggcaatgaaacgaatcaggcgatggatattataaacaacatttatcacataacaagcacaaaccattacaagaaaaacaaatacacacgagatataacaaactcactattatgaatttaaaaggtaaaaagcaatgaaaaagagttttagaaaaacaacatttctgtcggccttggcaatagctgttccggcaatgggcatggcgcaggacaaagtagaagccagcgtaggagccgactttgtaagcggatacatctggcgtggccaggatttggggggtgtcagtatccaacccacgttgtcagtttcttacaaagggttctcattgtctgcatggggaacagcaggtatcgaaaaagaagatacaaaagagattgacctcacattaggctacaccacaggagggttcagtatctccgtcacagattactggttcaatggaggaccggggtatttccattacggctcacacaataccaaccataccttcgaggcacagataggttatgacttcggaccgctggccttgaactggtataccaatttcgccggaaccgacggagtgaataacgaaggagacagagcctattcttcctacatctcggctaccgtacctttcacactggcaggactggaatggacagcggaaataggagcgactccgtgggccacagacttttacaactattccgaagaccctgtatgcaacggttccaacggtttcgccgtatgcgacatcagcctgggagccgccaaggagataagaatcaccgattcattttccgttccagcttttgcaaaagtcaccgtaaacccacgcactgaaggggcttatttcgttttcgggctaagtttttaatcataaagagcataaatacaaggataacaacaaggtatcagttttttagaaggtaaaaagattacattatatacaaaatacaaatacaacaatgaaaaaaattgaagctattatccgtaagaccaaattcgaggacgtaaaagaagcgttgctcgaagccgaaatcgaatggttttcctattacgatgtaagaggcattggcaaaacacgtcaaggacgcatttaccgtggagtggtttatgacaccagttccattgagagaatcctggtttccattgtagtccgcgaaaagaatgtagacaaaaccattcatgccattctcaaggctgctcataccggcgagatcggtgacggacgtatcttcgtcatacccgttgaagatgccatccgcatccgtacaggagaacgtggagatattgccttgtacaatgcagaacaagagaaataactcattacacaccccggtcaaaactactctacaaagtaaaaatcatactacaacttaagcgaaaaaattatggatacaactaatagaaaaggtatggaaaaactatacctgaaaagactctttatacttttatttctgttcccagccagcctttgggcacaagacgcactatcggaaactcctgtcagaagcacggacacagaagccatcaatgaaattgtaaccggtctgaatactgtatggatgctgctggcagccatgctggtattcttcatgcaaccgggattcgctttggtggaagctggatttatccgcaccaagaataccgccaacgtactgatgaagaatctgattgactttatgttcggctccatcctcttctggttcatcggtttcggattgatgttcggtgtgggagttttcgtaggtacgccacattttttcaaccttgacataatggacaaagtcattgacaacggactacccattgaagggtttctgatcttccaaaccgtattctgtgccactgcagcaaccatcgtatcaggagctatggcagaacgtactaaattctccatgtacttggtatacaccatcttcatcagcgtactgatttatccggtatcaggacactggacgtggggtggcggatggctgatgaatggtgaagaaaattcttttatgacaaacatattcggaaccaccttccatgacttcgccggttccactgtcgttcactcagtaggcgggtggattgccctggtaggtgctgccgttctaggaccgcgtatcggtaaatatggtaaagatggcaggtctaaggctatcccgggacatagcttgacattggcttgcctgggtgtattcattctttggttcggttggtttggttttaatccgggttctcaactggcagcagctaccggtactgatcagacagttatctctcacgtattcctgaccactaacctggcagcatgcgccggtggcttcttcgctttgacagcaagctggataaaatatggaaaaccttctttgtcattaacattaaacggtgtattggcaggactggtcggagtcaccgccggatgtgatctcgtttcccccttcggagcagtcatgatcggtgccatctgcggcatcgtcatgattttctcggtagacttcattgaccacatattgaaaatagacgatccggtcggagcctcctctgtacatggtgtttgtggttgcctcggtaccattcttaccggacttttcgccaccgaagaaggactgctctatggtggtggttacaacttcctgctagcacaactgttcggtacaacagtagtaggttgctgggcagcaggtatgggatacctcatcttcaagggattggacaagattcatggtttgcgcgtcccgaacagaattgaagaagaagggctcgacatttatgaacatggcgaatctgcatacaactaaaagtcattttgaatcaaaataataaagagaaaatcattcactctaaataaattaacaactaaacaaatttaggtattatgtcaaaattaagattccgagtagttgaaacagctttcaagaagaaagcagcaacagtagaaacacctgcccaaaggcccggtgaatactttgccaagtatgtattcaaccgtgaaaaaatgttcaaatacctgcctagcaatgtctatgccaaactgacagatgctatggacaatggcgctcctttggaccgcagcatcgccgacgaagtagccgcaggcatgaaacgctgggcaaccgaactgggagtaacccactatacccactggttccagccgctgaccgaaggaaccgccgaaaaacatgacgcgtttgtagaacacgacggcaagggcggaatgatggaagaattctccggcaaactacttgtacagcaggaacccgatgcttccagtttccctaatggcggtatccgcaataccttcgaggcacgtggctacagtgcatgggacccctcctcccccgtattcgtagtagacgacaccctgtgcatccccaccgtatttatcgcctacaccggcgagtccctcgactacaaggcccctctgttgaaagcgttaagtgctgtaaataaagcagcagttgatgtctgccattattttaatcccgaagtaaagaaagtaatggcctatttaggatgggaacaagaatactttctagtagacgaaggcctgtacgccgcacgccccgacctattactgaccggacgtaccctgatgggacacgaagccagcaaaaaccaacagttggaagaccattacttcggggccatccctacccgtgtggcagctttcatgaaagacctggaaatccaagcattggaactgggcatccccgtaaagacccgccacaacgaagtggctcccaaccaattcgaactggctcccattttcgaagaatgtaatctggccgtagatcacaatatgctcatcatgtcactgatgcgcaaagtagcccgtaatcatggtttccgtctgctgctacacgaaaagccattcaagggagttaacggatcaggcaagcacaacaactggtcattaggtacagataccggtatcctgctgatggctcccggaaagacagccgaagacaacctgcgtttcattacttttgtcgtcaataccctgatggcagtttaccaccataacggattgctgaaggcctccatcatgagtgccaccaatgcacatcgtctgggagccaacgaggcacctcccgccatcatctcttcttttttgggcaaacagctgacacaagtgctggatcacatggaagaaagtgcaaatgatgaccttatttcgctggctggcaaacagggaatgaagctggatatccctcagattcccgaattgctgattgataacactgaccgcaaccgcacctctcctttcgcctttacaggcaatcgctttgaattccgtgccgtaggttcggaagccaactgtgccagtgccatgattgcactgaacacggcggtggcgcaccagttgacaagattcaaaaaggatgtggatgcattgattgaaaagggagagccaaaaatctccgccatcgtggaaatcatccgccaatacatcaaggaatgcaaacctatccggttcgatggcaacggttactcagacgaatggaaagctgaggctgccaaacgcggtctggactgcgaaaccagttgtccgctgatattcgacaattacctgaaacccgaaagcatcgccatgttcgaagcaacaggcgtcatgacgcgcaaagagctggaagcccgcaacgaagtgaagtgggaaatgtacacaaaaaaaatccagatcgaggctcgtgttctcggtgacctagctatgaatcacattattcccgtggctaccgaataccagagcaaactgattgacaatgtatataaaatgaaagaattattccctgcagaaaaagcgtcccgactatctgccgagaatatgaaacttattgaagagattgcagaacgcaccatcttcatcaccgagcatgtggaagccatggtggaagcacgtaaggtggctaacaagatagaaagtgaacgggagaaagcaatcgcctatcatgacactatcgcccccatgctggaagagatacgttatcacattgacaagctggaactgattgttgacaatcagatgtggacattacctaaatacagagaattgctttttattagataattgcccgaaattatctatttcttttgttggttgttttaagtttgcatgacaggctttgttgcgaaacaaggcctgtctttttattaggtagacacatcataaacaagaaagatgaattacaagcaaggcaccttcacaaatgctgtatccgggaaatgcttctctatataacgacaaatataagcctctgtatctgcctgaatgattttatcttctccttcgggaaacagattgtacatcactgtatgaagctttatccctctccgttctatagcctcaaaactcaataatgtatggttgatacttcccaatcgtcccgaagtaacaaaaactaaggggtaacccgattcctgaatatagtctatagtcaggttctcctctgtcaacggcaccatcagccccccggctccttccactaaaacagcatcatagcgctcactcagcacctccgtggcatgctttattttatcaaaatcaatggtgcggttatctattcgtgaagccaaatggggagaagccggataagaaaatatttcaggtttggtaagtccctgctcatcctcaggcaaatactccgtccccatcagacgacgatgcaactcaatatcctccgaataaccttccggatttcctgtctgtatgaatttttgagtaatagtacgacatccttgtttgttccaaagatgtgccagataggccgtggcataacttttaccaatatttgtatcaataccacttacgaaaaatacattctgtttcatgattctttttatttctattgtcttttctttgcaataatataaataggatgataagtcaaagtcaccgaacgaccatcactgaacaaacgggcatacttgtcacagaaatcctgcaaattccttttagtccacgcttgttgcctgacagcagccaccccggtatgtttcaagtgataaagcacttcgagcggagtgccaaaagtcagacagatacgttcctcatgagccttcacaatctcatagtgtatgcgcagtgcttcttctaactcctctaaagaacgatagtgaagaccgctgccggtaaccgatgcaacttctttcagattatccctgccgaacgtagtaaaagcaaaatatcctttctgcttcaacaaagtattacaacgttcaaaaaacagctcgggagaaacaaaccactgtaatgccgagcatgatacaatcaaatcctgtccttttggaaaaggaagggactcggcatcccctgccagaaagatagcccgcccgcttcccaacaaatcggtgaaacaagtactcatctcctgacaaatatcattcaacaccagtttttcaggatggagggtttccatcagcctgcgggtaagaaagcccgtcccgctaccaatttccaatatccggccgcacggacggggcaaataatgatttagcatatcactcatgcggtatgcaatctgcttttgaaccaccgcctcacggttataactctctacagcgcgggaaaagcgacgggttatcaattgcttattaatcatacgttttcattttaaatgacagacgggcatagcaaatctctcattatttcttctgaataatgaggaatatcatactctgccacttccgtcccggtccatgcatttctttggttgaccgccgtaaaaatcaaatcattcttgcctataacagcccgttcccatgcaaaactgggaacagcgcaagattttacctgttctccaatcctccgaagctcttcttgcagttcctctaccgcacgttgcggacgtttcgacaagaatgtttccagattctcctttttcaaacacatcctgcggataaacttttccagcgtaacctcattcaagccttccagtgttccttcaaaaacttgctgcgaaatacctttcaaatcatcgacaggagttaccgtgccatttaaagcaacactctcacaaatgggcaagtccatatcctgcaataccatagacgcggcccatactcccatagaccaggctatcagacgaatctcctgataaccctgcaacagcgtgaaatcaaaatccagcgaacgataatcataacaaaccaacagatcgctatttccggagcaataatccatgaaaggacattcatccattccccaaccggcaaaaaaaagtgtcaatcggggaagataattttgttgtataaaataatgtttcatatcaattctatcagactttttatttcttcttcagtaatatccgctgtcaacgaaaaacggatacgcgatgttccttcgggcacagtaggaggacgcaccggcaacgcataaaaacctttacgctgcaagaaatcggcctttaacaccgtatcaccgctatcgcctatcgtcattggcagaatatggctggtagaaggacaagcgtagcctttctttaccaacgcgtctttcaaaagagaggatatcttcttcaacctttccctccggaagctgaaactgttcaaatgctccaggataaagaatgtccatagcaagttgacaggaggaagagccgttgtaaatatgaatgtacgcattttattgaccaaataatcacggatggtcttcgaacaaacaatatagcctcctaccgaggctaacgctttaccaaaagttccacataagaaatcgatgtcagccacacaatcctgttcttccgcacaccccaggccatgcatcccccgcacccctacagcatgcgcttcatccacatacagcaatacattatcatattgttgcttcaaagtgaccaaacgacggagatcggcctcatcaccgtccatactgaaaatactttcggttacaataattattctatcatacccggcatgattggaaaccagcaactgttccaattgttcgtaccggttatgccggtatcggatacacttggccgccgataaacgaatgccgtcaataatactggcatgtaccagtttatcggcaaggatcaatgtacgagtatcgctcactgcaggaagaataccggcattcatgtgataaccactattaaaaaccaacgcgctttccttccgatacagtcgggcaagcaaatcctctatctgaacatagatatcaaaatttcctgtcagcagccgagaggatgaagaggaaggaagaaaggtgtcgggagtaagactttgcaagaattccgtacgtaatggcagataagcagccaatcccagataatcgttggatgaaaggttaagcatcacttttccattcacctccacctctcttcccaaatgacggataacaggcaacttacgaagattacttttattttcaagcagggctaattccctttcccaatctgttaatgaattcattttttctatttctctcagtactatcacttattcttttaattctcttactatcttcaccagtgaatgcgtcaatttgctcaattctccaggctgaattataaaaggcggcatgatatacaccagttttccaaaaggacgtacccataccccttcttcaacaaaacgacgttgcatgaaagccatatctaccggtttcttcacttcaataaccccgatagctcccaatacacgcacatcagccacttgtggcaataaagcagcaggggccagctccctcttcaactgtgattcaatggcctttaccttttcctcccaactataggaaagcaataattccacggatgctttcgctacggcacaagccaacggatttcccataaaagtagggccgtgcataaagactcccggataaccgccggaaattgtatcagccacatcatcactggcaaggacagcagagaaagtcatgtatccaccggtcagtgccttgcctatgcacatgatatcgggctggacacccgcatgctcccaagcaaacagtttccccgtccttccgaaacctgtcgctatctcatcaaagattaacaacagccgatattgcctgcaaagtttctctgcctggcgtaaaaactcaggatgataaaaacgcattccgcccgccccttgtacaataggttccagaatcaatgcggccatctcttcatgatgctgttccaatatttccctcaagggctctatatcctcttcataccagattccgtcaaagcgcgaccggggagcaggaacaaaataacgcacaggcaatgtagggccaaaaatatgatgcataccggtcaccggatcacaaacagacatggcattccacgtatctccatgatatccggactgaatagttacaaaattatttttcttttccttcccttgcgcataccaatattgcacggccattttcaatgccacttccaccgcaaccgaaccggagtcagcataaaatattttctgcatacggggaggaacaatcttcaacaacaacctgcctaattcgatggccggatcgtgtgtcagtccgccgaacatgacatggctcatacggtctatctgttccttgagcgcttggttcaataccggatgattgtatccatgtaccatgcaccaccacgaagacatcccttctatcaaacatcttccgtcctccaattctatatatactccatccgcccgtcttactttataagtgggcagcggatgagtagtcgatgtataaggatgccataaatgctccctgtcaaaattttccatatattacttccttattgttataataactttataatgtatcaaagcgaatacccggcctcttctatcaatattttatcttctgatacttttgaacctaatgtagtcagcaaatctcccacaatggcagaattaataccgatatacaatgctttctttacagcttccacactcatcagtgaacgccctccggcaaaacgaagaaatgctgtgggattgataaaacggaataaagcgatggttgtcagaatctccacctctgcaagacgatccattttttccaatggagtgccgggtataggctgcaacaggtttataggaatagactgtacttccaattccctcagtgtaaaagcaaactcaatacgctgttccattgtttcgcccatgccgatgattcctccgctgcatacatccatccccaccctgcgtgctgcctgcaacgtttctaatttctgttcttgtgtatgagtagaacatagagatgaaaaataagagggagccgtttccagattacaatgataacgggtgatgcctgccttaaacagccgtctcaattccgcctcatccagcaatcctaaagaagcgcataactgaatatgcgaatgcgcacgcatgtattctgttgtctcacatagccggttcaagttccggctacccggtttcctgccgctggtcaccaaagaaaaacgggatactccctgcgcttcgttatacaaagcatggcgcagacattcttccttcccaaccaaatcataaacatccacttttgtttcataatgtgcagactgtgcgcaccatttacaattctcaggacatttaccggatttagcattgatgatggaacacatatcgaatttccgggaagcccagacctgtgttatctcatgagctgcatcatacaaatcctgtttctctgccttgcaggacagccaacaggcttcttctacggtaatcttctcaccgcccagcactttgtttcttatttcattcagcatcatatacagttcatattaagacaaaaaagccgaaaagatgcatggcacatctttccggcaaacaatatttattcaaataaaaaagacaaatcacatcagccacctgtggttgaggcagttggatccgaagcatttgcaacatagattcaacagggggcattccttcttcatattcctctccagcatcctcttttcgtgcggaagagcaaacagagaatgccgtgcaaacatttgcctgtttacccaacgatacatcggcaatctcctttttcagattaccaatagttacacatttgcccaaactataaaatatagcgtacttcttccggttccaatagcggaaacgtatcgtatgtttattctggcacaattgtttcatattttttcgtatctgagattggcaaaggtaaataaaatattcaatgcagcaaacttttatatagaaaaacaccgttccgcctcttccaaccttaaaaccagttttccgaaagcacaacggtgaattcttaagtcctttatactatttctgttattcttctttcttcgaagcagctttcttggcaaccggcttctttgccgccgctttctttgccgccgccggtttcttggcagcaggttctttctttacggcaggagccttcttgccttcagctttctccagtttagcctgcaatctctccacttccttgttcaaagccaccaattcctcgccctggttcttaatggtagtaagcaacgaatttaattcttcgttatccatatccaccggatacaacgaattgacacgacttataaaatcacccaaaatattcatgtagttggtgaaagcatcatacggagaatcataaattccacgattcaaccaaataccggtattcttagtggtcatgaagcggaaattattacttgcctgcaaataatcccaatcctgcttaatacggcgatcatcgcacaaatgaacacgttctgccacactataaagtttattgaaagcctcacgctgcatcacattgcctaaccacggactgatatcgcgttcctcgtctacccatgacataggataaggaacatccacctgatccacagatttcagtttggtaatgatatcggtcggagtagagaaagtaacccctctttcttttgcgcagacaggcagtgctttcataaattccagaatattggaagacaatggctgggcgatacccaaagcagaaagttccatgaaaatattgataacctgttcctcctccggcaaagctgcaatccaatctatatatttgtcggcaaacaacggatattcattccattcggaattagagaaacgcagactgatgtcatcagacaatttgaaatcgcgaagcaataacttcaagttcggattcatggcgcaatgatacagatagtgcggactcttccaacccaaaatatgttttgcaccttcagtcaacatacctttaaagcccatatcagctatcgtagcgccaatatcattcgaataaatcaagctggagttacggaatactttcggctccttgccaaatatttgtttaatcttggtacgcatacgttccacttcttcgcggaaacaatcttcattagccaatgaggaaagaccgtgagaataaggttcgcacaagaattcgcaacatccggtctcattcaactgatgcaacaactcgattacaccaggcgcatgcacttccaactgttccagcgccacacccgagatagacaaagccaccttgaaagtatcaccgtgattctttgccatttcaatcaacgcactcagcgcaggaatatacgagcgttcggcaatatcactgatgccgcgctcattttcataatcatcataataataatggtcacggcctatatcaaaacagcgatagcgtttcagatggataatttgatgtatttcaaaataaagacatattgttttcatatcctagttattgttttattatttaccatagttttttaacacctgctcatagagggcacggattctcaagccgactttctcccatgtaatgccatccacttctttctttccttcttcctgcagatattggaaaagagaaggattcgtacaaattgaatagatggcatcggccattgcgttgatatcccaataatcggtcttgattactttatccaaaatttcaccgcaacccgattgttttgagatgatagaaggagttccgcactgcatagcctccaaaggagcaataccaaaaggttctgacacagaaggcattacgaatacatcactgtttttatatgcttcataaacctgacgcccacgctggaaccccgggaagtgaaaacggtctgcaatacctcgttccgcagccagattgatcatggcatccagcatgtctcccgatcctgccattacaaaacggatattacgggtacgcttcaagaccaatgcggcggcttccacaaaatactcgggtcctttctgcatcgtgatacgccccaggaaagtcaccactttttctttcgaatgatcaggacgaggaatgtccagcaaatcttgcgaaagcggataaacggcattgtgcatggcaaaacatttgcgcgggtcttgatgatattggtgaataactgtctgacgggtcagctcggacacacacataatacagtcggcatgatccatgccattcttttccatagcatataccgtaggattcaccttaccgcgcgaacggtcaaaatcagtagcatgcacatggatacacaaaggtttgccacttaccagcttggcatgcacaccagccggataagtcagccagtcgtgcgcatggataatatcaaattcttgctggcgcgcaaccacccctgcaataatagaaaaattattgatctcatcatgaaggtttcccggatagccgccggcaaactccatacaccccaggtcattgacgtgcatgtacgagaaatcagaatagatatgatcacggaaagcataatactgttccggagtcgaagtcgaaagacgtgactttaagtaatcgtaattcacatcacgccacacaatgggcacttggttcatgcctataatgttcagaaacttttcttcgtcgccgcaaggtttgggcaaacagaaggttgtttccatatcaccttgcaggctcaaaccttttgttataccgtaagatgctacagcaagaccaccatatattttgggaggaaattcccatccaaacattaatactttcatacaggtccctcctttcaataattgtatttactcaataaatataatactcgcaatatctctgccacattcatagcgaatgatacagctccacgacctttgaaaggcgggttaccatcaaacaattcaggtatagagccaatacaatgagaagtcatttcgtcttcgtagcctatcagctgacgctccacaaatcctataccactcatcttataaatacgaaggtaagcttcaaaatagaagcctgccagccagggccatgcggtaccttgatgataagcataatcacgctgcatctgaggacctacataatttgggttgtaaccaccactcttcgggctgagcgaacggagccctttcggggtaagcagttctttggtcacaatgtccaacacccctttcttctgacgggcatcaagcggagaatagtcgaatgctacagtaaatatcatgttcggacgcacgctccagtccatcatattgccatccacataatccagtaaataaccatactcattcaagaaagtatccacgaaagccttccccgtcttttctgccaatacatttaacgcatcagccaaattattgtttccaccttcgctcaatagttcacttgtaaagcgtaaagcattataccacaaagcattaatttctacgatatagcctgtacgaggaatcacagggcgtccgtttgcggtagaattcatccatgtgatagccttttctgtgccgttggcatatagcagaccattggaatgcaagaaaagattcggatgattctcccggcgaaggtactccataatgtcttgcaacaatgtaccatatttctcacggcattggtcgcgcgacaccatcttggcatattgctggatacaccacaccgcccaaagcaaaacatcaggatgctccatttcgtacactttaacatcatcaggctcatcattaataaagtcatgaattgccttgcgggccgtttccatcaccatttcaaacttagccacttcatcaatcgccaatgtcagtcccggcagggaaataaacatatcgcgcgcacggcatttaaaccacggatatcctgccagaatataaaactcatttccttgtttattcaagaactgatgagcagcatttatcagacagtgctggaaattatcacgtggagtacgttcttccacctcttcttcaaaggttctctttaatgtacgggtactggcctcggacacacctcctgaaaagacgatgctttcacctttctttatgtccacttcaaaataacccgggacgtacaaatcttcattaaaatcatatcctctctcctgctctttgggatactcaattccccgataccaatccggctgatagtggaattcgttcttcttgttcaattgcatatataattcgggatagcccggatacatgcatgtcttaattccattatccacctcctgatagtcacgactggcttgtgcgttctcatgagtatactgacggacactgcggaaagccagaaacggacgcaaacgcaacgtagtggccgaatgtgcctccaacaaagtataacggattaaaattctattttcatgatgaacgaaaagcttttccttcttcagaatcacaccacctacccgatatatagtggtaggaactttctcacactcgaattcccggatatacttgtgtccccttgggctgtaattgtcgccctgatacttatgaagtcccagattaaattcagcgccgtgttgtatcactgtttcatccaacgacgatagcaatacatggttttcatcatccagttcaggcaccggaatgacaagcaatccatgatattttctcgtattgcaatcaacaatggttgtacaatggtaagcccctgaacggtttgtgcggagaatttctttcggtaatgattccccgaggttcgtcataagagtcttgtcaaatcgtaagtaactcatagttgttattttaaggttataaatcaaatttccatatcaatttatgtcacatattatttttgtatgcaacgctcaaaattagtaattaaatggataaagcaaaattaaatagcaaaatatttttcatttttcgctcaaatatccgtagtattgcacagaaatcagcataattatgacaaaatgaaacttgaaattcaaaaaattctattggcttttgctcttccgttattacttcttttcattctgtacaccctgcgtacaatggaaagtgtcatgaattgggattttatcacctggggcatatatcccagagaaaccaaaggaataatggggattttcacttctccattgatacacgctgattggggacatttatttgcgaacacttttcctcttctttttttattatggtgtctgctctacttttatcgtgatttgggcattggtatactttttttcatctggatagtcagtggaatacttacatttataataggcaagccgggatggcatataggtgccagcagtataatttattcactcgccttttttctgttcttcagtggcattctccgcaaacacgtccctttagtagccctgtcgttgcttgtcacttttctatatggcagtctggtatggaacatgttcccgcagttcgcctcctccaccacttcttgggagggacacttggggggcgcggcggccggaatagccgcagccatattgttcagacacaaaggcccccaacaaccggaacttttcattgacgaggaagaggaagacaacagcagtcatccggaaaacgaagaagtcattacgaatccggaccaagaaaaaaagaatgactaaatcaatctttccgccaccatgaagttcaaagggccggaagggctgaaagaagcaataacccgctaacggaattaaatgaatgttcatatcctccctattgtataagtcttttctatcttcagattaaacctttttatacagatatattctatctccatagcctttggagttatctcccaagactatggagttaactccaaagcttatggagataactccaaaggcttgcggagataaaacaagcaggaagaaaaaccttaaccacacggcagaaaagggttagggatacaaacaagatcttttaaggatgaatctgattacaaggcttgcactctttacagagaaaaatcccctaacacccttcttttaaaaaggtaaaaaagcatgtgacaagaagatatgcatctggccatatgtggaaagactaaaacagactattattttgccatcttaaattttaatgcatcattttacaactgaaaaacagggtaataaacctttccggacagcatcattcaagctttaatacctactcattaccaattttcataaaataatacccatttttaggtattgcccacccttttaacctcccataactttgcaccgatttaaaattataaaaattaaagcaaaaatgaaaagaaaggttttattgttctcattatgcttgtcggcctgtcttgcaaacagttatgcagaaaaagcaacaagtatagataaggataacacagagaaaactacggaggaagaacctaaaaaaaaatcccggctaacattgggaggttacggagaagcagtgtacacacgtaatttttatagtgacaatatgtaccgctattctaaagcagacagttacaaagactctgacggacacggacgcgtagacttacctcatgtagtaatcatgattggctacgatttcggaaaaggatggagcatgggtagtgaaatagagtttgaacacggaggaacagaatcggctatagaagtagaagacgaagaagccggagaatttgaaaaagaaatagaacgtgggggtgaagtggctttggagcagttctggattcagaaatctttttgctcgggcttcaatatccgcgcagggcacatcatcgtgccgataggacaaataaacaacgcccatcttcccactcagttctttacagtatatcgtcctgaaggtgaaaacacaataatgccttgcacatggcatgaaaccggtcttagtgtatgggggcgtataggtgactggcgttatgaggcaatggttattcccgcattgaatgctaatatgttcaatcatagcggatggattcatgatggttctgcatcagcctatgaatttaaagtagccaacaatctggcaggagcggcacgtatcgacaattactctgtcaaaggattgcgtatgggaataagcggctatataggtaacagtttccaaaacgacattattaaagatgaaaaatccaccaaatataaagatgtgaaaggaacagtggtcataggtgcattcgactttgattataatgatcataactgggtagtacgcggcaattttgattatggccatttgggagacgctgatctgatctccactcacaacaaaagccaagacaatagcacacagtccccttatcctcacacagccgtgggcaagacagccattgccgccggaatcgaggcaggatatgatattttttctcaagtaaagaaaatgagagacaatggtaaaaaactatatgtatttggacgatatgaatactatgactcatatcataaggctgctaaaggtttcagcaaatatgaatggactaaaaaacaacgcatggccgtcggtttgaactactatcctatgaaagacatcgtagtaaaagccgaatactcaaaacgcttcttgaaaagccagtataataacgaaccctctttttcattgggcatagcttatgcaggatttttcattaaataaacccgattattcattttttaaaattaaataggtatgaaaagtttgttaaaattccccttacttgttgctgtagcaacaatgatgagttgcagtttcagcgcatgcagtgataacgatgatccgactccggataccggtacgtctgaaacagatgcaaaattcgaagcaatcgcaaaacagtatcttgatcacacggtatatgttacttacaagaacctggctgatgaaaccgaacagctagtaaaagatttacaagcattaaaaagcagcaagactgatgcaaatgtaaaagctacctgcgaaaccttccttgaagcacgtgcatggtgggaaaagagtgaagctttcctgtatggggcagctaccgatttcggtatcgacccgcatattgactcatggcctttggacttggacggattacagaccgcactgaaaaatacggaacaggtagaagcaatgggtggtgaagacggagatatttatgccggcgagaaattgggtaattctttattaggatttcatggtattgaatacatccttttcgaagatggtagccccaaatcagtttctaaaatcagtgacttacatctgacttacgccgtagctgtagctggtgatttgcgtaaccgttgctggcagctggaactttcatggagaggcgaaagtgctgtcaatgccgaccgtgtcgctaaagtcgcaaatgagttagaactgccttacactgtaaacagtggtgaatattcttatggtgagaatatgctgaatgcaggaaaagcaggtagtacatacgccagctggacattggccatgcaagctatcattgacggctgcaagactatcgcagatgaagtaggaacttctaaaataggaaaaccttatagcggagaagaccctgcttatatagaatcaccatacagtcacaagtccattctagacttttatgacaacatcatcagtattcagaatgcttacatgggcggtatagaaaatgaacgtgacgaaaccaactcactacacaactatattgctggagtagataaagaactggatacaaaagttgtaaatgccataaacaatgctctgaccaaaatcaatgccatggcagctccatttgtaaacaatattaaagatccaagtgcaggtgaagcaattaaagcttgtcaggatcttgatgccatattgtctgatgttaaaacagctttaagaaacaattaaaaagaactgtttaccccaatgaccacaaaggatctgcaagagggtgtccggaaaaggtctattgtactatcttttgctgtagatggtgattttacattcgctccaagcaccggctttgtgctgccggatgtcccctctacaacagacatgatagtgaaaaagaccgggggaggacaaccttatgtagattctttggtatataaatttgaaaagtaactaactttaaacattcttatatgaataagttatttaaaatacactggcttgctgctctatgcggccttacaatgctctcgctaacagcctgtaatgacgatgacaatccggaaaacaaatctccggaagtcaatcctgatatcaacgtaaatgtagagacctatgcaggcggagaattgggtacaaccttcaacaattccgcttctgcttatgaagatcctactcctgcaacggaaaatgcaggtatgaccgacaaattcaaatatggggaatatttctttgaacgttcttatacgcagaattccaaacctttcaatggtttgggaccgctttatatccgcaattcatgtatgaactgccaccccggatacggtcatggcaaacgggtagaccgttatcgtgctgatgactggggaaatggatatctacttgttgtgaccgatggaaaggataactacctaagttctttaacgggaatgcctcaaaccaaagctgtagcccctttcaaagcaccaatagatgaagataagataaaaatagactggctgccttacacagacgaatggggaaataaatttcctgacggagaaacatacagtctgatctatccggaagtgactattcctcaagatgcatactacgtacctttggaggctacttataatcaagttgtcacccctgtcaactactctgatgtagtagttttgctggaatctaccattggtatctacggaaccggattactagatgccattcccgatgattcgttgaaagcagaatatgcacgtcaggaaaaagcaggtgtaaaattgaatccagccatcttcgcaaacggagagtggacttcactctataagggacttacaggtaaacaatatcccaaacgttatacttacgctttgaccagatcttccatacaggatggtcccggtgccaatgcaatctggaacatcaccaatgttacccgtagtgaccgccgttatcactacatgactgacacgtatgccaaaacagcctccaaagacccggatgtacaaaaagatttttataactatttccctgaatggaaacagaccggtaatgtagaacaagatatatacaactatctgatgaataaggaacttccggtggaaatgacagacgaagattatgtaaacttcatgatatggcacagaggactggcagttcctgccgcacggaatctggatgacgaaacagttcagagaggtcacaaattattccgtgaaataggctgtgctacctgccatcgtccgtcatggactacaggagacgataattatcccgatccgaacggatacttcaaagatggtgacagccgtctgccacgctatccacaccaaactatctggccatattcagatatggttcaacaccgcctggaaatgaagaacaatatccgcacgggatggtgccgtaccactcctctttggggacgcggactttccttaatctgtgccggacacagcgaccgtttgcatgactgtcgtgcacgtaatgtcattgaagccattatgtggcatggagcttcaaatagtgacgcacgctggagcattgacaagttccgcgaactcagtaaagaagatcgtgacgccatcgtcaaatttattgatgccatttaagcaatgaaacagattgtctccctcctgaatcctatcaccaataatatgacaggacattcagggggatgagacaaattcaagattcaccttctggttatctttcagaaaattataactacatgaaattattaaaacgaactgccttcagtctgctaggcatattacttctgattcttactatagctactatattggaaaaaatatatggtacggactttgtaaacgagtatatctacagttccgtaccttttgtcattttatggggagtaaccgcaattacttccttattatacatcataaaaagcaaactgcatcgtcagcctgttatttttttgcttcatctttctcttctctttatattggcaggggcattcaccacatggatatatggagaacaaggcactatgcgtgtccgccaaggagaacaacagacctctttcaccgattccaaaggaatttcccaccagctacctttcagcatcacactaaaccaatttgaaattatttattacaaaggaaccttggctccaatggactttatcagtcatatttcagtagcagacaaagactgccaccgccagatacaggggaaggtttccatgaatcatatattttcataccagcactatcgcttttatcaatcaggctacagtgaagataatgaaggaagcgtatttagtgtatctcatgatccttatggtataggaatcacttatgcaggatatactttattgctactttccaccgttttctttttcttcagcccgcaaagtcggttccgccaactgctgaaaagccctttactacacagaagcttgacagtcatcttgcttttattcgcattcagtctcaacagtaattttctcaaagcaaacagtacatcccccaaggtgcttccgcgcgaagtagccgaacattttggagatttatatattttatacaacaaccgtatctgtcctttacaaacctttgcccgtgattttacagtcaaactttacggtagttcctcatataaaggactgacaccagaagaagtacttaccggatggctgttttattatgacagttggaaaaatgaaccaattatacgaatcaagagtaatgaagcccgtaaattactggaaatagaagggaattacgccaggctgaaagactatatcagtaccattaatgaatacaagctggaaaaaatgatgaaccatatccgttcaggagaacaggtgactgacaaacgaggcatagaagaagctgatgagaaattcaatatcatcaatttagtatgtaccggtgccatgatgaaaatattcccttgtcgcaatatagccggaaagacattggaatggtattcgcaaagcgaccaattacctcaagatatggataatgacaaatgggtattcattcgtaaatctatgagttatgtaaacgaaatgattgtgatgaaaaagtacaatgatgcctgcctgttattagaaaaaatcaagaaataccagcagaaagagtgtgacggactgcttcctgcagataataaattcaaggctgagaaaatatataatcaatttgattatagcaaatctgtcgccatggcatgtatttgcatcggcctgatatgttttatctattattgccattgcatggcatcgcaaaagagaacaagccggaaggcaatcataatattgaatattttgctatggattgtttttacctatttgtcggctgctatctgcctgcgtggttatgtgagcaatcatctgccattgtccaacggcttcgaaaccatgcagttcatggcatggtgtacgctattgctcacttttctgctacaacgtaaattcgcaatgttgctccctttcggtttcctgctttgcggacttacgctgatggtatccatgctgggagaatcaaacccacaaatcacacaactgatgccggttctgcaatctccattattgagtatccacgtagtagttatcatgatcgcttattcgctgctggcatttatcatgctgaatggtgtaacagcggtcatactccaccaatcacagaaagaatgcaaagaacaaatagaacgattgcagataataagccaaataattctttatccggcaattttcttactcgctatcggtattttcattggtgctgtatgggcaaacgtatcatggggacgctattggggatgggatcctaaagaagtatgggccttaatcaccatgctggtatatgccttggcactgcatccgagatcactgccatggtttcatcgcaccatgttttttcatgttttctgtataactgcttttataacagtactgattacttacttcggagtgaattttctgttaggaggaatgcatagctacgcaaacggatagccctcatccatcaatgaaaagctatcctttccgaaacaaatagaaaccaacttggacaaagaacctgaaacactataaaaaaaggaaattacccccataaaagaagcactccccgcgaatcacttcgcagggagactactaactaataactaacttgtggtttacgtaatttttatatgacttatttacaatgcaaagataaggtttgccatctgtctgtgcaatcgcatgatataggtattctggacagtcagacatccctatttatagctataataaacgaaagtagaaaaggtatctatcaaaatcattatttgtaggtattgtctgagattattaaatgttgcaattttgccaaaaagaatttatcttattataccgtaaccattgatgtggagttctctctattattatttctctgtaatgttagtcacaaaagagagactataaaaccttgttccagggaagcataccttcggaacaacaaaaagtccggacttgggaaagcccggacctttattttatatccatcaatacaagatattaatacacctctacctttgcagcaacagccttgcatttgtcacgcagagcgtccaagtcactgccattaggagcataacaaaccacaacccccatacggcgattcaattttgtataaggtttaccaaaaatacggagataagtatttgtctccttacaaacttcttcctcaccacgataacggggagcttccttgctggcaataggagaaagaatcactgcactggcccctatgcgttcttgtgtaatttcaggaataggaagtcctaacaccgcccgcagatgcaactcaaactcatttaaattctgagtacctgccaaagtcaccattccggtatcatgcggacggggagaaagttcggagaaataaactccgttttcatgactcaagaaaaattcaactccccagattcccgcaccagtcagagctgccgttaccttatcagccatacgttgcgcttccttcaaatgttcgggatcaatatgtgccggttggaaactttctctataatctcctcctttctgtacatgtccgataggcggacagaacaaagtaggaccgtttttctgagtgacggtgagcaaagttatctcactatcgaactgaataaactcctcaatgatcaattctttaatatctccacgactgccttcacacccataatgccatgcctgttccaactcatccgcgcttttgaccaaagactggcctttgccggatgaagacatcaaaggcttcaccacacaggggaaaccaatttcttttgcagcttctttcaactcctccagagacttggcatagaaatatttggctgtctttaatcctaattccttagctgccaaatcacgaatagccttacggttcatcgtgaaattcacagcacgggcactcggcactacttggataccttcctgttccaaatgatacagacgttcggtacggatagcttcaatttcaggcacaattatatctggcttgtgtttggctaccacagcatccaatgcatcaccgtcaagcatactgaacacttcaaattcatcagccacctgcatggccggagcacctgcgtaagagtcgcaagcaataacatactgccctttacgttttgccgcaatgacgaattctttacctaattcgccggaacccagcaataaaatcttcttagtcatagtatttacatatgtttgatattccttacaaaaaacggagagttgagaacaagacacctcttgattcccaactttccatctgcaaagatagtgtattttataaactatacgatatcattgaagcaatatttggatcattcagtacaaagaaaacacccactcccaaagcgatgagccacaatacgataaatataattttggttacaatggacatgggttgccaacctccaaaatgacgcatcagcatgtgtatcagtcctataataggaataccgataaccagaatacctgcaacggacatagcgacagtcaaccccggagagctacccaccgtagcccaattaactgcaggcagcacctcataaagcactgccggcaatgcagcaatcagccccgtagccgccatcagcaatgcaaaaaagacaatcaataatacaaacaatacaggcgcacagcaaatagcaatgaaaacaagcaggaatttgataaggaaccccgccacagacacaatcccctcccctatcttttgcaagatacttctaggacgatctgagcgtacataatcattcactttttcaaatccgtctgttacagtcttgcctatattctccacattaatagcagcccccttcatggcgagtttctcgggggcggtatgcgccataggaataataatccacgctatgatataagccaatatcaccccatgaacaaagaagccaagaaccaatagaatgatacgtacccaagtaacatcccatcccatataagcggccaatccggaagccacaccacccagcactttattgtccggatcacgaaacagacggcgtatagtggtcccttttgtcttttccgaaccggatgtttctccattcccttcaccagagagttcttcaggtttacccatccgggctatgatttcttccacatcctcaatggtaataacctgtttgccctcattcaaacggtcagcaaacagttcagatatgcgtaattccatatcatgtacaatctcctccgcaccttcctcacgacgaaagtgaatgcgtaaatttgctaaataattatccaacaagtggtaagcgtcttcgtctatatgataaacggtacctcctaaatttatggttaaagtctttttcattgtatcctgtttttaattgttttttaaatgattcactgtattcgtcaactcctcccaagcagtctccaatccgctaaggaatatttcaccctgaggagtgagattataatatttacgaggtggtccctgagtagactctacccattcgtatgagagcaggtcatcgtttttcagccgggtaagcagcggataaagcgtcccttctactacaatgagccgggcttctttcaatctttgaatgatatccgaagcatatgacggctctttgtgcaacaacaataaaatgcagtattccagcattcctttgcgcatctgagatcgtacattgtctacattcataatttataatactttgtttggcacaaatatatgtattatatcagtaccatgtattgcatagttctattattttgcataaattaatatttaaacaagtaaaagaaaggaagttcccttttttttgttgtaaaaagtttatctttgtttctcgttataaccctaaaaagatataaagatcatgtttaccatacaaaaagcgacaaccaatgatattcagttgattaacgagatggctcagattgtatttccggccacctaccaggaaattctttcaaaagaacaattggattacatgatggactggatgtactctccgaaaaatctgcgtaaacaaatagaagaagaagggcacatctattacatagcttacaaagatggagaagctgccggatatgtttccatacagcccgaaggagaacatttatttcatctgcagaaaatctatgtacttcctcgttttcaaggttgccggttgggcaaagcactatttgagcaggccgtcaaagcaattaaagaaatccatcccggaccttgcgaaatgcacttgaatgtaaaccgtaacaataaggctttacaattctaccaacatttaggaatggaaaaagttgcagaaggagatttctatataggcaacggatattatatgaacgattatatcatgggactgaaaatctaaccctatcttacaaaaacaaaatggacgaatatcgtatcaacggattgaccataaaagaaaatttgctgcaactggcagaaaatggaaataaaaagttcaccgaatcgctgcatccgggaatagaaaatgtattgggtatccgcatccctgccctaaggcggttaggagcacaaattgccaaagatgactgggagagttatctacagactgcggatacttattatatggaagaacgtatgttgcaaggtatggtaataagcaatctgaaaatgaaagacatagaagcatatctttcactggttgcccggtttgttaccatcatcaacagttggtctgtttgtgacacttttgacttttacggcaaacaacggtttgttgacaagaacaagaaaagggtctggctatttttggaaaactggatgaaatccgacaaagaatatgagatacgtttcggagtagtaatggcaatggctcattatattgacgaagagtatataaacaacgtattgcaatggatggaccggatcagtcacgaaggatattatgtgaagatggctgtagcatgggctttatccgtatgttatgtcaaatttcctcaaaagacggtgaactatctgaaggaaaatcatatagatgactttacctacaataaagcgctacaaaaaatcatagaatcttatcgggtaagcacggaggacaaagaaatcatccgcagcatgaaaagaaaaaacaaataatgttcattatttaccgcaaagaggatttgaatccttccgaaagaaattcaccattcatattcggaaagattcaaactgctccagcagctattaataattgggaaaagttattcctcccaaaccaaataagctgaaaccagccaatgattcaatttattgccatccacctgttgtgcctcagggatacttaccttaaaagaatgtttaccggccggcaagtcaccaataacagcctcctcaggcatcacatcgctacccggacaccaattggaacgggataaatctgaagaagccaaaggttcttcaatctcttttgtcgtataacccttatcacctatatatgcggcaactcgtggtatcagccatactcccgtagctgggttaaaacggcggaaagaagcacagtcgtcacgccaaggaatgaaattcaacacctccttgccatcaacagacacaatgtttcgtttctccacaaactcatctccgccactatgccccccgtgacctgtaacaatatacttcaaacgaacattcttggcagctttcgacatatcaaaatccatcaccacatctttgcgtgagaaaatatccggataagtctgtccgatataatacaccgtattcatcaaaggcttcacacggcgctccggcatcacgtcgcaagtgatcttactctccttcacgtccaattccatgctggccacatacccctcggcagtccatgtatcaatataaattcccacgtatacctctctctccaatgccggataaagatcggtaatatcctgcacccaagtcacactcttttcccatttcgggatatatacaggacgtctcttgctgctcaaagaatcattatccgaactataataccccacaccgaacggggtcataaaacgcatcagttcaagggtaggcacataatccttacccggaacaataccaatcattttttcatatttggcactgtctaccgcaggaaacgccctcttgccttcggctatattcatcagattgatcaccgattctttgggaagcacaaaacaggagccagatttatcccaacggtcaccattggaagctacagttactttcagggtaacatccacatctcttttgtaatcgggcaaggttattttctttaaaataatacgcccgtttaccagacggatcactccgtcagcattggcaggagtataattaggaaaagagtcgggacgaaaacaaacaggggtcttgtcgaatacttgaatatgagtatttcccaatgccggtaattctttgtgatttgcggcatcggctggcatcataaaagttgccgccacagccagtggagcaataaaggtcagcaggttcattctttttaattataggttagtaatcaagggtatataaattaatttcacaaaaaaactacacggatttatacaaatcttccgatctgtataaatccatgtaatctacaataaaaaggggttattgatgctgttcacgcaacaaatcattcacagtcttcaccggattaaaggtactcaacggcacttcaacgaaaacagtgttccagtcactcatcgcaccattccacaagcccggaagttccaatgctttcagttctctaccgttctttgatttataagagataaaacctgtagccttatccacatacttcaccaagtcgaatttgtttcctttataatctcgtaccgcacacaccaaatccaccggattaaagtgagtacctttctcgaacatctctttcttggccggatcattcatgtcaatctgagaactttccaaaatttgcagtgaaacagtaccatccgcattataagccaggaacgggccgcctcccggttcacccacattcttcaccataccgcatacacgcatcggacggtttaacttcttacgcagataaataaccaaatcggcatcttccagatccttgatatccggtttgcggcaacataaagtctgctgtaagaaacgaatgatctcttccagctgcgcatgtgtatatttaccgccatccagcaattccaaatattcaaatacctgcttctgcagagtaaccagtacccccgcaatcagctttttatacgtaacagtatcctctttcaagcgatcgggcaccacattatctatattcttgataaagataacatcggcatccaggtcattcagattctcaatcagcgcgccgtgccctcccggacggaacaacagtttgcctttatcgcggaaaggtttgttctccatatcggcagcaaccgtatccgtactcggtttctgttcagaaaatgacacatcatattctactccatacttctttgcataaacggcaaccttctcttccaccagctttgtgaacaattcacgatgttccgtagaaacggtgaaatgcacattcacttttccggttctgcctgccgcatacaacgcgccttccaccaaatgttcttccagcggcgtacgcacaccatccgcataccgatggaatttcaacaaccccttcggtaatgccccatagttcaagccggcagcttccagcagattggctactataggtttataatccttcccggccatcaaagcatcaatattctttcctgtattatccatacaagccgcattcaagtcattgtagaatgcgaagctatgaatatggtcgaaaaatttcttttcgaaatctgtcttcggagtattgtaatcagcccccaggaattcgaacaaattcttgaacatgcggctggcagcaccagaggcgggtacaaacttcacaatggttttctcaccttccttatatgtatcccatgcttccaaataatttttcatttcaatttcggcgggagccatgattcccttttcaacagaagcggccgcatccagcttcaaaaatgggaaacccttttcaaagcaagccagttgttctgcaatctgctgctcggaaattccttttttcactaataagtctttgtcttcaggtgttaacataagtacatgattttatatggtttaaataaattgttaccttattctttcactattaattgcccaaaaatacaaaaaaatgcgagaacactacctaataaataaagaaaaaaactacctttaccctcgaaaagatttcacgtgttatggaagaaaaagcatttttcacagccaaagagcgtgagcaactgttcgccctctataaacgattgctgcaattatccggcgacaccttgcagaagggtgattgccataagttaaaaatacacctcataaaagcagttgccgaaggtaacctgccacgaaattgtttcgggatgaatcctatcatcaaagatatgcagaccgccgtcatcgtggccgaagaaattgggatgaaacgggcttccatcctggggatcatgctgcacgaatcggtaaagaaccatttatgcaccttagcatctgtacaacaggaatatggagaggatgtagcggggatcatacgcggtcttgtgaaaatcaatgagctatactccaaaagccctaccatagaatcggaaaatttccgcaacctgctactctcttttgccgaagacatgcgtgttattctgatcatcattgcagaccgcgtgaacctgatgagacagataaaggagactcccaatatagaagcacgcacccaagtagccaacgaagctgcctatctgtacgcaccgctggcacataagctggggctatacaaactgaaatcggaactggaagacctttccttgaaatataccgaacacgacgtatattatcatataaaagacaaactgaacgaaacgaaagcctcccgtgacaaatacatagccgcctttatcgaaccgatacagcacaagctggaagaagcaggattaaagttccacatgaaagggcgtaccaagtccatccattccatctatcagaaaatgaagaaacagaaatgtcccttcgaaggagtatatgacttgtttgccatccgaatcattctggactctcccgtcgacaaggaaaaacaagaatgctggcaggtatattccattgtgaccgatatgtatatgcccaatcccaaacgtctgcgcgactggctctccgtacccaaaagtaacggatacgaatccttacacaccactgtaatggggcctgaaggcaaatgggtggaagtacagatacgcaccgaacgcatggacgagatagcagaacgtggtctggcagcccactggcgttacaaaggcgtaaaaggagaaagcggtttagatgaatggctgacctccatccgggaaacactggagaacgccgacagtgacctggaagtgatggaccagttcaaactggaattatacgaagacgaagtattcgtattcacccccaaaggtgacttgtacaagatgccgaaaggagcgaccgtactggactttgccttcgccatccatagcaaactgggttccaagtgtatcggagcaaaggtgaacggaaagaacgcacaattaaagcaaacgctgaacagcggcgaccaagtagaagtcatgacttcaaacacccagacacccaaacgcgactggctgaacatcgtcaccacttcgaaggcaagaaccaaaatacgccaggccatcaaagagatagaagcccgccagacagagttcgccaaagagaccatagaacgtaaattcaagaaccgcaagctggaatacgacgaagcagtgatgatgcgcctgataaaaaagctgggatacaaaaccgtaaccgagttctaccaggacatagccaacgagacaagagatgcaaacgacatcatcgaaaaatacctggaactgaagaaaaaggaaacggaaaaccgggaagatattgtctatcgcagcgccgagaatttcagcatgcagacagcacaggatgacaagaccttcaaagaggatgtgctggtcattgatcagaatttgaaaggactggacttcaaattagccaaatgctgtaaccctatctatggcgatgatgtattcgggtttgtaaccatcagcggaggaatcaaaatacaccgtaccgactgccctaacgcacgagaattgcaatcacgttttgcctaccgtatcgtaaaggcgcgttgggctggaaaaagccacggcaaacaataccccatcacgctgcgcatcgtcggtcatgatgatataggaattgtgacaaatatcacctccattatcaataaggaaaacgatatcctgctccgttccatcagcatcgactcgcacgacgggctgttcagcggcatgatgaccgtaatggtagatgacacttcaaagctggaatcattagtaaaaaagataaagacagtaaaaggagtaaaacaggtaaacagaggataaacccatcccaagcttaaaaaaaatgaatgaactgcataaacgactaaaaagctttacatacgcctggaaaggcgtatgtagttttttaagtaaggaacacaatgcctggatacattgcacagccatcatcgccgtaaccattgcaggcatccggttggaaataacacgcaccgaatggcttgtcatcctcctgtgctttgcaatggtactggctgccgaagcattcaacacagccatagaacgcctggtaaacctggtatccccggactaccatcctgtggccggagacgtaaaggacatagcagcaggagccgtactgatttgcgccatatttgccgccatcatagggttgataatctttgtcccttatttttaaaggtgttaatttaccatttatttcactaacagttaaagaccttttataaaaaaaacagtaatttagccccgataatttttaaacagtggaactaatgaagaaaattttgctttcaacattattgttgattatagggttaaccacatacgcagccgtatggcaatctcaaggagaagcagaaataacctttgagaaaacaacacataatttcggttcatttcccgagtcaagcccgaaagttacctgtgttttcaaattcaaaaattcgggagatggtcccctagtcatccatcaagcgatcgcatcttgcggatgtactgttccccaatatcctaaagagcccatcaaaccgggtgaaagcggacagataacagtgacttataatggagccggcaaatttccgggacatttcaagaaatcaatcactatccgcacaaacgggaaaaatgagatgacacgtctttatatagaaggtgacatgaccccgaaaggcacagctgccgaatagaattctcacatcataagagagaggatgtatcaaaacaaaagaagattcgagtttgatacatcctctttttatatccggaaaacactgccccgcctgcctgtatgcaagtaaaaacaaaaaaataagaaaaaaagaacatttttccccaataataagccactcttattctgattaaaataacgtactttgcagcaaatttaagagaacaatgacaaacaagctattattctttgtcctactggccctctgtttcagtggctgtgacatgctggaaacccatccatacgatgtacatattacaggagaaagagaactgaacaacaaaaacatccagttgatagaaaacaaaatgcaaggcaaaaaaacaatccgctttgccatgatcagtgatacccaacgatggtacaactctaccgaggatgttgtaaaagccctcaatgcccgtggtgacatagactttgtcattcacggaggagaccagtccgacttcggtgtcacaaaagaattcatatggatgcgggacatatttaacaaattccagatgccctacgtatgccttttaggcaatcacgactgtctgggtacaggtgaagacgcatacagggccatttatggagatcccaacttcgccttcacagccggaaatgtacgctttatctgcctcaataccaatgcgatggaatatgattattcggaaccggttcccgatttcaactttatagaaaatgaactgaacaacctgtcgcctgaaatagaaaaaacggtattcgcaatgcacgtaaaaccttttgaatttgtattcaacaacaatgtagcaaaaatcttccaactatacgtcaaccagttccccaaagtccagttctgtctttacggccatgaacacaaattcgcagtagatgatctattcaacgacggagttctgtatttccaatgcccctgcatagacaaacgcatctacttattattcaccattaaagaagatggaacctacgattatgaaacagttgaattttaaaaagatatttctgaacctattgtggccactattgccttttacggcacaagcccaagaaaataatacactttactccatcttatccaaagacagcatacttgtcccctctccttccgttcaaaaccaagaggaagatattgtaacccaaatgccaaaccggcaccataaatacgacaagcgcgtacaccgttacaggcgtgcgtgggaagctttgatccccacccacaccaaattacagtacgccggtggaatgggcctgttatcctggggcataggctgggattatggaaaaagaggccaatgggaaaccgatcttcttttgggcttcatcccccgctactcatccaaacatttcaagatgaccatgaccttgaaacagaattatatcccgtggagtatctggctgggcaaagacttctcgctggaaccgctgactaccggaatctatttcaacaccgtattcagcgatgatttctggacaagcgaacccgagcgctatccccgtggatactacggattttccacccgtatccgcacccatatctttctgggacaacgcgtccgtttcgacgtgcccgaaaagtaccggaagttctctaaaagtatcaccgcattctacgaaatcagcacatgcgatttatacgttgccagtgcgttcaacaacagttatttgaaacccgatgactatctgagactatcatttggattgaaatttcagatattctaatcaaatcatgaggatgtttctctattttttcactatttttgggcatttattatgataaatttcaaaaataataacatagagaaacatgaaacaagaagaagaaaaatcggttggattgcccgataacgcgttccgacctctgaaaccgggggaacaatatcaccccatcatgtcaccaaacaaaaaatatcccgaagtaaacctatggtctgtgctatggggtatcgccatggcggtattattctcggcggccgcagcttacctgggattaaaagtgggacaggtttttgaagccgccatccctatcgccatcatcgccgtaggtgtatcgggagccgccaagcgtaaaaacgcgttaggtgagaatgtcatcatccaatccatcggtgcctgttcgggagtcatagtggcaggagccatcttcacattgcccgccctttatatattgcaggacaaataccccgaaatgacagtcaacttctttcagatgtttgtcagctcactgctgggaggtattctgggaatcctgttcctcatccccttccgtaaatatttcgtcagcgacaaacatggcgaatatcccttccccgaagccactgccagtacgcaagtgcttgtttccggcgagaaaggcggaagccaggcaaagccattgctttttgcagggctaataggaggtctgtatgatttcattgtagccacattcggctggtggaatgaaaacttcaccacccgcgtatgcggctggggtgagatggttgccgaaaaagccaaactggtgatgaaaataaacaccggtgcggcagtattaggcttaggctatattgtcggcttgaaatacgcggctatcatttgtgccggttcattagtggtatggctggttattgttccgggtatggccctgttgttcggcgatcaagtgctgaatgcatggaatccggccttgacacaaaccattagcgaaatgtcacccgaacttatattcaaggaatatgccaaaagtatcggtatcggtggtatcgccatggccggtgtgatcggtatcgtgcgctcatggggcattataaagagtgctgtgggactggccgccaaagagatgggcggcaagaaggtggaagcaaacgtcatccgcacgcaaaaagacctttccatgaaagtgatcgccttcggttccatcttcaccatcctgctgatcttactgttcttcttttttgatgtgatgcatggaaatgtattacacagcattgtagccatcctgctcgtagccggcattgcattcctgttcaccaccgtagcagccaacgctatcgccatagtcggcactaacccagtatcgggaatgacactgatgacactgatacttgcctcggtagtaatggttgccgttggactaaaaggcgctaccggcatggttgccgcactggttatgggtggtgtggtttgtacggcactctctatggcaggcgggttcatcacagacttgaaaataggttactggctgggcagtactcctgccaaacaggaaacatggaaattcctcggcacactggtatcggcagcaactgtgggcggcgtcatcatgatcctgaacaagacctacggcttctccaccggcgcattggcagctccgcaggccaacgcgatggcagccgtaatagacccgttgatgaacggtgtaggcgctccctggctgctttacggaataggcgccgtactggcattggtgctgacctacttcaaagtacccgcactggcttttgcgctgggtatgttcattccactggaattgaacctgccgttgctggtaggcggagcggtgaactggtatgtcactacccgcagcaaagacgaggcggtgaacgccgaacgtggcgagaagggaactttgctggcatccggattcatagccggaggcgcattgatgggggttgtcagtgccgccatgcgctttggcggtatcaatctggtcaatgaagaatggctgagcaacccgttgagcgaagtgctgtcaatagtcgcctatatcctcctgatcatatggctggttaaagccagtatgcatatcaagaaaaaataaccctttttcaaataccgtgaaaataaaagctatatgaaacgaatcttactaatgagtttacttgcaatctctaccgcattgtctgcccagaaacctgtagagttggaattatggcccgatggcgcccccaactccaacggcatcaccacccccgagcagaaattagagaacaaccggatttccaatgtcagcgagcctacccttaccgtttatccggcagccaaaccgaacggactggccgtcgtggcttgtcccggagggggatacatacgcctggcaatgaatcacgaagggcacgatatggcagactggttcaacgcacaaggcatcacatacgccgtattgaaataccgtatgccaaacggacaccatgatgtaccgttgagcgacgcccatcaggctatccggctgatgagagaacacgccaacgaatggcatattcaaaaagtgggtatcatgggggcctctgcaggcggacatctggccagtacggcagccacccactatacagccggaacgcgtccggattttcagatcctgttttatcccgtcataagcatggatctgtccaactgccataagggctcacgtgacaatcttttaggaaaaagcccgtcagaagagctagtgagactttactccaatgaactgcaagtaacaggcgacactcctcccgccttcatcatgcatagcagcgatgacggagctgtacccgtcagcaacagcgtgagctattacctggcgctggtaaagaataaagtccctgcttccctccacacctatcctatcggcggccacggctggggcttccgcgacagctttacctataagcgccaatggacgggagaattagaaaaatggctgagagaaatactgtaaaaaagcaaggaggcgtgtcaaaacaaaaatgactgctcctaaaagttacagatagtaattataacacttaaaagggtcgtatcaagctctgtatggagtaatgatacgaccctttctttagtcttttaggatgctcaattttcagattataagttcatatttccaaaaactgaattgggacacacccactttctatttccaataaacacctgcatctttatctgcagaagacaaaaaaacaggcattcgtttctcttatcgcttattttcttgcgccaagctgaatatccaagtgatacaaagccacatcaccacccagcttgatcttgtccaaaataccttgaacggtagcttcctcttccacctgctcgcgtacaaatccccacaagaaatcctgagaagccttgtccttttcagcagaagcaacatctaccagtttgtcaatcaattcggaaacatggcattcatgcttgtatacatgctcgaacacatccagcggagaggcccattcctgaggaacagcatccacagcccccaccttggcttgtccgccacgtttcatcacatattgcgccaacatatcagcgtgatcattctcctcatgagcctgcgctttcatccatgaagcaaaaccttcatagcctttcgcagcgaaaaaataagacatggaaagataaagattggccgaccacatttcggctacaatctgagcattaattgcgtcttgtaatttttgtgaaatcataattcttttatttttagttaaattgtaactgttgcaaatatataatttttctagcgattaacactatgtctgtccacctttttataaaaattatattttatctcatccaaatctttgcggttcaaaagaaaagtcttacctttgcacccgctaatacgggttattagcattaattcaaatcattaattataaaaacattatttagaaatggcaactaaaatcagattgcaaagaaacggacgcaaaagctatgcgttttattcaatcgttatcgcagacgtaagagctccacgtgatggtaaatttactgaaaaaattggtacttataaccctaataccaatcctgccacagtagatttgaattttgaacgcgcacttcattgggtaatgtgcggtgcacagcctactgatacagtacgtaacatcctgtcaaaagaaggtgtttacatgaaaaagcacttgctggggggtgttgccaaaggcgcattcacagaagcagaagctgaagctaaattcgaagcttggaaaaacaacaaacaatccggtctggctactttgaaggctaaactggacgaagcaaagaaagctgaagaaaaagctcgtttggaagctgaaaagaaagtaaatgaagaaattgccaagaaagtagctgaaaagaaagctgctgaagctgctgccaaggctgaagcagaagccgctaacgctcctgctgaagaagcacctgctgctgaaactactgaagctcctgctgaagcataactcattttacttcaaaaagaacagctcctctgattatatcagaggagtttttttatgctcttatccgaagaatcaaagggagtttatctcatcttccgaaagtccggtaacttttgcgatttcagctatggaaagcccggcattctttaaatttcctgcaatagtttgggctttcatccattcacctttcgcaatgcctttctccatccctttcgcaatgccttcctccatccctttcacaatgccttcctccatccctttcgcaatgcctttctccatccctttcgcaatgccttcctccatccctttcacaagtccttcctccatccctttcacaagtccttcctccatccctctcgcaatgcctttctgaatagctgtatcaatcacattgttccaatctctatatactttcaaactctcctcataggcataaaggttctcttttgagaactgagcaatttcggcagcctcaaacagccggttgaacacacgttcctgaagggcagtggggcgttccatcaaacgggccagattcttgagcacaaacatccatttatcaaacaacgtatccaactcctgctcggttttatggaatttgggcatttccagatacacaaaagtcagtttgtcaaaaaacacttcatgagtagttgtatccatcagcttcacttcatggcggaagctggaagacgaaacatcatccaaggcaaaattcaaaataccgatcacatacaccgctttcagttcatagtcccagatttcccctttaatagcctgttccctgataggataggtagcatagtaaatactccggtccttgaaaaactgttgctcccctctctgcatttctatcagaatcttttctcctttttcattttcacaatagacatcaaagacagcccggcggtcagtctctttgctgcccagatgctctgtgttcaagtaggtgacatcctcaatgacctgcttgccgtcgaacaaggcattcaggaagccaataagaatttctttgttcaagtcggttccaaacaataatttgaatgcaaagtccgtatagggatttacatatctttcacgcaatccttcactacacataagcgtttgatatttaaagttgttttaactctgttgaaagcagttcaatacaaaggaacgaaaaaaaagcggatttcaagaatgttatctgctaataaattgttaatgttccaatatgtcactcacctctatagggggaaagcgtttatacaaagacggaaataactgtataaagagtttcgtaataaaaaagaaaaagggctgttccgccggtcaactccttatgtttttaacttacagtctgtaaatattcaaagaaatatcattcaacagatttaagatcattacttttctaccccccaaaatgagttcacattctctacttataaactgtaagcaacaataaagaaacgtgtccaaaaactagaatgactgctccgaaaagttacagatagtaactataacacttaaaagggtcgtatcaaactctgtatggagtaatgatacgaccctttctttagtcttttaggatgctcaaatttcagattataagttcatattttcaaaaactgagtttttgacacccactttatttatcttcaagtttaaaaccttattttgttacttcaggttcaccttgcagttcaaatttagcatttcctaaacctttgaaagtataagtataagtaaatgtttcaagcccattatacacttttgcagaaatgacatagaaacaatcaaccccacttacttgcgcgccggctgtaggatactctgttgccaagatcagttcaataccctcctgaaccatagacaacaaataagcctcagcctctttatcatctgccggaaccaccccgtcggggtcattcgaacggcgtttagccaactggatattgaagtttacataataagagctgccaccgaaccagtattccgagtttccatatttggcatccatatacccggcatccttattcgctttcacccaattttccaaaatcaaataatcttcggaagccaatgatttcgttaccgtcggatcaaacaaccactcggttccattatgtacaaaattcactttttctttcagttcaatattgttattcagaacccatgtaccctccttgaacaaatactcgtccacctccatcgtcgttaccttattataatatttgtacatgacggcttttgaatccccttcctgggcatatggaaatttctgagccaggaactggggcagataattctccggagcatccgaagtgctgaagttatcatgactgcccgggcttcccatagcgtcataatcggcaggagtcactacaaccaatctgctatcttctttaaccttccaagccgttccgtcaaactgatacaatgcattataaggcttttcattcgtcggagccaatacagccgatgaaatacttacattatcgagctgaacagtcgtggttttcgccttgggcccctcgcctacatagcggaacgcaacataaacgcttttgccattgtatgcctccagaccggctttccctacattcacaaaattatcattgtaaccgttggcaggtccttcaggaaaagtaaactggtctttcacgctagtccactgtgccatatcaatcgaaccatttcccgcatatgtatcggaaaccaatacatccagacaatccgcattatagtatccgaactttatgtcgaaagacagtccggcatctttgctcgtcactgctactgccggagaaacaagccaagtatccacctcaccctcaaagccattggccgagaattgtgcgtaaccattactactatagttttttccctgccattttctatcgcctttcagagtcacctgctcccagccttccaacacgatatcctcattgaccgtaaccgactcaaagtcctgagagtacaagtcctcccctgtaaattcaggatcaacatcgtcatatttgtaatctaccagcacaagatcaccttttgccgcatccttatactgaccggccagccactcgggcaatacggtagccggagcatgtgccggagccaggaacttcacgggagagccttcgccccacagggcctcataatccttatcacccaaagaagtattagtcactgtcctatactccagtacgtaatcggaaggagtattctgatagttataggtcactcctaccgaagagcctttcccccatgaaggcagcatcttcgcgatgatggaaggaacatacttctcggccgatgcaaactcgttcaaagccttatccgtcttgacggcattcgccaatgctttttcagcatccgaagtggcagccttcgccgccgcagagctgatagtttcgtaatcggcatcagtcagtacatattccgccatcgtctgggtgttcgttgtaccttccgcatcgatttcattataaatatcgtccatgggatcacatgccgcagcaaagaatcccaacagagaccatgcaattaaattatattttaacttcatatttattgactattttagagattaaaagattactttaaaaccggcagaccatgtagtaccgaagccgtaatataccaatgcagttttccagtcatggttcgtaccgtccttggcatcggctatatattccgtattagtcaaattatatacattactgtatacgatggcacggatatctttggtgatattgaaacgatagttcatacccaaatcaatcgtaccataatccggcaacttccaggagtcaataccggcgtctgcttcattcacccggttctgaggatcgaagtctgcatagttcttgccgaagaagttgtagtcggccgagattttaaatcctttgaacggttcccaagaggcgctcaatgcggaagtgagctgtgcggagttacccacatggacatctttcagataagcgtcgtatgttccgataggattattcgcttcatcatacatagtgaaatgaatatcatctttccatttccaatcgcctaaagagaacatacctttcaattcaaaggacttgacaggacggtaagtcgcttccagttccacacccatgtggactgcgtccaatcctgtaaggttggcatattcctgaccgatcttacggcgcaaggacttatccatccattgagtgtaataaccattcaatgcaatattgacctgttccgtgctaaatccataacccaattcgaacgtagtaatcttttcgtagggtacatccttttcgggagctgccgtattgcttgcaaagacagagttgaagaaaggcgcgcgggtaaaatatcctgcattgacaaatacattgtggttgtcattgaacttatagttaaaaccacccttcacgctccaaggcagaaaattctgaaggctggacactctgtccagtttatccgcacccgtggcagagtatcttgaatccgtaccaccacggtcatcgtatctataagcctcttcggtcaatgatgccgacaggaatcccgaccacttatcggtattatattcagcctgtgcaaaaacaccgccccagaatatctctccaatgctatagtaattgaacttgtcacccactttcagcagctggttcttggtttggaatgccagcggcgaggtctgcagatagaactcaccacccagcaaatcatcaatttcctctgtatgataccctttatagtaacgtaagtcaatacctcccgtaagagtcaggttctcagtcagatgattcttataggaactcagcatgccataccagtcatggtcattgacagcattggtaaagatcacctgcgacccgttctgagaagccgcattggcagccatagcacgctcgtagtcgaacaaaccgtccggagtcatcatcgcaccgtctttagggcggccggtgttgttatcaatagtcagccaattgctcatcgcgccacgggcacggcgtccgccgcctgtagccattgagccgtatagagaagtggtcagtgtcgatttctcgtcgatagtccagtaatgattcaaagaaacctggggcttatgataataattatagccgtaaccgctacctaccgcttcaccgttgatataaccatatccgttattgaaacgtccgccgtcggggctgttcttgtaatcctcgatatagtgcatggtagagcgctggttgtgccactggggagctccgaaagctgtcaatgacaatttatgatgatcgttgattaccttcgagatatttccaaaataagtccatccttcataattggtacctttcacgtaaccatctcccgtattcagcgaccccatgaatgtaatagcccatccgttgtccatcaatccggtagagaaagaaaccgaatacttgcggaaaccgtcgttaccgataccgaaataagctgatccgcctttctgggcttcggtacttttagtaaccatattcatggttcctcccacagaagaaatacctaaagctgacgcacccaaaccacgctgtacctggataaactggctcacatcagacaaaccggaccagttagaccaataaaccttaccgttttccatgccgttgatgggcacaccattgatcagcacgcccaggttggatgaatcaaaaccacgcatattgatacgggaatcaccataaccaccgctttcacgggttacatacaccgaaggaactgatttcagcaattcggggaattccagattacctattttctcctctatcttggccagtttcacgttagaaataggaataggggtctgacggtcactctttataatagaggcaataacactgacctcacccaaaccaatagcatcaggagacatcttgacctcacccaagtctatcgtattgcttccttttacttgatgcgtaatttcgttgtaccccaagtacttgaatataagagtagccttggaagaggtaagtttcaacacaaagttaccgtcaatatccgttacagtacccagtgtcgtaccgctgaccgatacagtggcaccaatcaatggctcattgttctcggcatctactactttaccttttactgttccttgcgcaacagccgtagcagtgaaacagattgtcagaactgccaacaggaggaaatgctttagatgatttctcataattttgtctttgatttaaattaattagttagtatttcattcccaataggaaagacaaagataaaactttaattcatataaattgcatttatattagactatttaaacgaaaagggtactttttaggcggaatatgacaattatgttaagaaaggaacaaagagccgcctcaggagaggggaaaactgcccggaaattccagagcaactgccacatgattactgtagggggcaaatgggccgtgaccgccggtccggacaaatcaggcccgcccccctacagcaaaacaacaggtcattttcattcagactctctcacttccccaatgacagagcaaaaagaaaacggacaaccagccttacaggatatccttatgctgcttcatcctctccctcagcgcctccagcttctcggcctgtttcttcaactcgtacgccttttcctcggctgcctctttccgcttccagttattgatataggcatccactccctcctgcactacgcggcggaacacctcctcgcccttcgctttcagcagatggtcggcaaaatgaatataataactcactttcaaatccaccccctttttagggaggcgtaagtatccggccccacatgctcatctccgagaacacgcaccttcgttatcttcaaccgattcatcaataactctaaaaactctcccaatttggggaaactgcactctgcattagacattttaaatttgttttaagttgtaaaatattaaataaacctcttttttttcacgttacttcacaatgggactgaaagaagaaaaagcaggatgcctttacaagaggttacgggcacgtttccacgatgcaacccattaacacggcccgtgcataagctactgattgccaatgccggaatctttataaaaacggtattccccacgataaaaagtcttttgtgatactacctttccggcctctcgcagccgttacaccttccatcccgtcatttaatccgttcttcctaccttcgggaagaaattcagaggacgcaaaaaaaatgcggatgcaaaattaatactttttaaataaaacgaatcatgaatcaagaacgtaaactatcttttttccttccccccatctcgccggtgaaggacgctaacgggaaaaacgtgacgcctgccacgctcgtccctcacaaggaactgaccttggaggaagtatggaacatagtcaccggcagcccgcggctgaagaaactgaccgaagccgcagccgccgcatacggtgacgagaaggagtaccgcaggctgaaacagagcaccctgccatacgtcaccccctgcggaactttcagctaccgccggagcgaccggctgctggctccttcgggattgagcatactggacctggaccatctggacagccgcgaggaggccgaaaggatgcgccggcagttgttcgacgaccctttcctgctgcccgaactggtgttcgtaagccccggaggacacggcgtgaaggctttcgtgccctacgatctcggccggacaagcgacgtgaaacagaatgcggccgagaacatctactggctgatggaatacgcccgcctgaggtatggcgactgctcggacaaagacaagggcaaaggagtggactactcgggcaaagacctggtgcgggcctgcttcctgtcgcatgacgaaggagccttgatgagagtcaagacgcccatgggctaatgtgccaatccccatgcggaacagaacgcggccaacgggcatagcagcacacgggccaacgggccgcttattcagaatcattcagaaacgaggtattcttataccgaaaccaaattaacataaaaaggaatatgaatcattacaaaaacaatcttttggaagaactgcaccgcctgacggaggcggtacaggcatcacacgcggacatcgcgcccacctatctggaatacacccaactggcatttgccatcgccacggactgcggtgaggcgggccgtgcggatttcatgagcctgtgcagcctctcgcccaagcatgacagtgtggcggcgaagaaactgttcagcaacgccctgcacacctgcaagggcgacatccacctgggaagcgtgttccacctggcggaaatgtgcggagtgagagtcgccccctctcacaaaaacgcagacgcagacgcagcagacgcaggcccttttttctcacacacgtgcgcgcgatataataaggtggagaatgaagaaaaagaaacaggaaaaaagaagcacgaggaagaggaaaaggaaatgaagggaacggaacccctctctcccctaccctactttccgcaagatcacgactggcccgaaccgctgaagagcatcctctcctttgccaagaccccggcacagcatgatgtgctcctgctgggagcaatgacggtgctgggcgcctcactgtcgcacatcgtacgctgcaagtacggggacaaatggcagtatccctgcctgcagaccttcatcacgggccatgccgccgcagggaagagtgtactggtatgggtacgcaaactcatagagcccatacacgaggaaatacgccggcaggtggcggagagcatgaaagcttaccgcaaggagctaagagcctacgaagcgctggggaaggcacgcaaggacaaggagccgcccgtggcgccgcccaaccgcatgttcatcatccccggcaacaacacgggcacgggactgctgcaaaacctgatagactcggacggaacggggattatctgcgagagcgaggcggacaccgtatcgacggccatagggacggaattcggcaactggagcgacacgctgcgcaaggcgttcgaccacgaccgcctgtcctacaaccgccgtacagaccgggaatacaaggaaaccaccgcctgttacctgtccgtactcctctcgggcacgcccgcacagataaagccgctcatctcctcgccggagaacggacagttctcgcgaaacatattctattacatgccccgtgtaggcgaatggaaagaccagttcggcgaagatgaactggacgtggaagcagagttcatccggatgggacacgaatggaaggccagcagggacgagctgaagaagaaaggactgttcaccctgaaattcacccagcagcagaaagatgagttcaacgggcacttcagcgccctgttctaccgctcttctctagtgacgggcgaagagatgtctgcttcggtgatgcgtatggggaccatcctgtgccgcatgatgtgtatcacggcgctgctgcgcagtctggaaattccctcgctggccgtaccggatcccactataaaccccgaaaacctgaaggacggtatcatcacccggcataacctgtccatcaccgatgaggacttccgcgccgtgctggctttgtgcgagcccctgtaccttcatgccacgcacatactttcgttcctggacaaaagtacggaactgaacagccggggaatagcggaccgtgagatgctgtatgcggccctgccgcaagaattcaccaaacagatggtgatggagcaagcggagaagctgaatatcccggtcaacaccgcacgcagctggatacagcgcctgagggaaaaaggcgcgctgaatatggtgatggtgaaagggaaaggagtctactcaaaaaaacaaaggtaacaaagaaaacacgcgcacatgcatatataaggtacgtgcgcgtgtgtgagaaaaaaggacctgcgtctgctgcgtctgcgtctgcgtttcgcatctccggttgtgatgccggtattcccgtggatctccctgtgctcccggagaatccccggcattcccgtggatcttccagcatcctcagggctcccccaacgcctctacgataagtttcacctcaaggggcaggaaagtgtgtgacagctcattgtatccggcagctcgcatcgcccccatcagtcccggcttgcggtctatccagcgcatcagtttgcgccgtgcggcactctcggtaatatcgggactgtagcacagggccagttcgcttttcccgtaacttcttatctgaaaattctccatgtatgttcgttttgttttgatacaaatataccctttttccggcagaccgtcaaacattatgaacagcgaatcgcgtcaaatcgcgtcaaatcggaccattccgcaccctatcgcaccttatcgcgtcattgccctttccgcacatcgtatctttgtaatgtcgggacgatgaaggcgaaagatctataatcttacagccgtaagatatagcatcttacacgtgaaagatagggttcttttagcggtcggtgaccagtggctgacttcatcctccggcaatcgtgtttcttaattctcaattatcaacttttaattttaacaaactatggtaaattacagtatcgttatgcgtaacaatccgatggatgcggatgccgcgaaaaaggcttacgccagtgcacagtatgctgaagtgatggacatcaaccgctttgccgagcacatcgccagccacggctgtgtgtacaagcgtgcggacatcgtggccatcctcaccatggcagtggactgtatgcgcgaacagcttctggcaggacagaagatacagctgggtgatttgggggatttctccatcagcatcaacagtataggtgcggaaagctcagccgcctacaaccctgccatccacgccaaaaagctgaatgtgaactggagtgccggaacacgtttccggaatctgctggaagatgccgtgttcaatctggtggccacacgcaaggcggcccgactggtggtgaaggcgctgaaagccggaaagaccaatgtagaccttaccggagaggcgaaagagccggaaaacggaggacaggcctgacggaccccccagtacgacggaagcaaggcacgacgctaaagggctgaatgtgcccctatgacaagctgttttcattggggcacaggcccttggtttccattttaattcatttattatcaacccactaaaacaaaaatcccatgaacttgaaaacaaagaaaaacacctggacactgattctgaaagtaatcatcaccgtagccaccgcccttgccggcgcgctcggactgaacgcctgcatctgatgatcatgagaaccatcaccttgattattatccactgctccgccacccctgaggggcggaggctggattttgagacctgccgccgggaccacatccgccaccggggcttcacggacataggatatcatttctatatcacccgcgacggagagattcaccgcggacgccccttggaaaaggtgggagcgcattgcaggaaccacaaccggcattctatcggcatctgctatgagggtggactctcggcggactgcacacctgccgatacgcgtactctgatgcagaaagggagtctgctggcattgctgcgcgagctgcgcctcctgttccccaaagcgttgatagtggggcatcatgacctgaatcccgtgaagccgtgcccttgttttgatgctgtgaaggagtaccgcttttaaaggaagcttttaccaaagatagggtttccaatgagaaccgtttgttttcaaagaggcttcttcaaagatactgtatccaaggatgatgtctccaaagatagcgtccctttcctccactttgatttcctgattcttcattcaactaatcttttcatttaacaataataaaaatgaaccatctgataaaccaactcatgaccgtggacaaagctttctaccgtcattatctggaaatgctgctcaccctgaaccgcatccaagccctcaccccctggcagatgtccatgctgctgtggagagccaagattttccatatacaggtgctctaccccgaactgctgcgcatcagcctgtgcacggagcaggaaaaggacgagatacgctttatgaagggatggaaactgaaagagctggagaaaataatgcctgcatggcagcgacggcagtgcgaggagataaaacgggaacgatggagaggcttttagtggtcagtgtatatccggaacgcaatgccacgcaaaatgctcttgtttacgagcattttgcgtggcattgacgtatgtccttaatatcttcaatagttaacccactatccatttctctatattacgacttttcttgctgaagttcacccctaccttaaacaatttgcgcccgtccgtctcgaaaggtcgggcatactgtttttcattgatctgtcgcaaggcttcctccgctgtaccgtttaacttgaattccattacgtaaataaatctgtctgtctgcagaaccaaatccacgcgcccctcactggtatgatattccacctttacataaaatcctaccaacttgaacacaatgaaaagtacattctgatagtgtaactccaagtcgcgtatcatctcgtagggcgtatcagcaaagaagctctgaaggcggcggaaaaaggaattatagtcaccactttccacttcacgggtaaatttcaggatttcgaaaggagactccactttggtaaccgttgtataataaggcagcaaaaaacgcatgaatccttcctctacctcccggttaggaaagcctagataatagataccgaaacgctcatcataccccttgatcgtaagatacccgctctgataaatcaccggaataggattcgtggactcggaatcaatactattcagcacctggatatccgtttcctcgtgcgccatccgttccaagtcataatgatgtttttgcagcaacctcaccagataagtcggcgtaccggtctcaaaccagtagtttccgaactccttccgtttgaaggcattaagcaggctgaaaggattgtaaataccgatggaattatgtgtaaaatgataaccgtcataacactctttcagttcggcacagatttcatcgtatgtcctcccccgtttttcagcaaattcatgaagttccggctccagccaggtttgaatttccttgtcactgaccccacagatatcaataaactcattccacatggaaatatcgtccaagttgttcaaatcgctgaacacactgaccttgccaaacttggtaacccccgtcagcaaagcgaacttgatgcaaccgtccattgtcttcaacactccatagaagggtttcagtatgctccgatatgctctctgaagctcctcattgccgatggcttgcagcatgggcttgtcatattcgtctaccagaatggcaaccctctgccccgtctgctcgtaagcacgttttatcacgcctttgaaacggagggcgagggatgtctcggaaggagcggaaccgtagacagcttcccagttggtcagaaaatcattcagcatatcgctcaaatcctctgctgtctcatattttgagatattcagatcgatatgcaggacgggacgtactgtccagtctttctccagtccggctatggccagtccttcaaacaattctctcttgccttggaaataggcttccagagtagaaaccagcagacttttcccgaaacggcgcggacgactgaggaagtaataactgccggtctttaccattttgtagatcaaggccgtcttgtcaatatagaaatagccttccttgcggagtttctcgaaattctggataccgatgggatatatcttatcactcataaactattgttctttataggataacacacaaaggtacttaatttattcttaattccaagttttttcaaaacaaggaagaatacgcatacaaaagaggcgcaccttcatgggtacgcctctctatcctgttcctgtattgtctgatacaggctatttcacttagttaaagatataacggacactgaactgtatggaatacgtagaattgaaactgttcagattggaatacgtatcagtcagtttctttcctccgttcttctggaactggtaagcaccactcttataactcaacaaggaagtattgttcaccgtcttataaattccccagtcgctgttcagcaagttcaggaagttcttgatatccactccgaactgcaaggtattgcgcttgccccctacattgaggaagaaatcctgattgaacttcaaatccagctgatgatgccagggcatgatggctcctccgcgttcggcatacttgcctttacggcctttcaggtaactgtcctcattaatgtaagcccagaaatcatcgcgctgctccttggcggaataagtcacctcacccgtcttgctgtcagtataatcggcgaagttccacttatccagcgcctcacgggatgccggaatgtacagcaagttatttgagccgtaatcgcctacaatgttcccggtgaatgtataggaataacgggcggcggaatatcccccggcatagcccatgttcataccctcataaatcaaagacaaggaggaagcgaaattcttggcgtatttaatacggtaagcggcggaagccagcacacggttgggcgatacatacgtaccatagccggtctccgtgtcattgtttccgttgacagagtaacggttgttgtaataagccgagttcacctggtcgccgatgccgtcgccatacgacttggcataagaacgggtgtaggaagcggaaagatgcaggccgaaatcaaatgtcttggccagtgaggcggtgagtgagtaataataagcgctgtttcccgcattggtgatataataagcgtccgtcttgttcgaattggagtactcaaacattctgcggacatcacccggagctatctcctgctctcctttaaacttacgtcccaggttggtcacagtagccggattgaactctttgctgaaaataccttccaacgtaaagtcaatatctccgggaagttttgcatccaaagccagtgaagacttccaggtggcgttcatcttcaggtcgcggtcaatgatggtggctccggaaggtgcggcgggatcagtagctgccggaaggttcaggttaggatctttcaacatatcggccacactggtgtggaagcccggctgtccgtacttggcatccttctgctcgttataataataagtgctttgtccgcaattggcattacctactgccgaaaccagccatacgaacggcagacggccgatgaagtaaccgctaccgccgcgcaatacatacttacgctcgcctgtaaggtcccagttgaaaccgatacggggggaggcggtcagctggtaggatgaaggcagctggtctgtggcgtaatgatatccgtcaaagtcaatctgtgcgaaatttttgttatagttgttcttcagctccggataaatgggcagttcgaaacgcaccccggcagtcagtctgaagttgtccgtgatattcatctggtcctgcagatagaaagaaagctgctggtacttcatgttcgccaggaactgggaaccgtccccggtgttggaataagtgacaccgaaggcagccggagctctgttgttcacaaaatcatcccaggaggaatagacataataaccgcttcccgcctgcatgaatccgttcactgccttattggactcaaactggataccgcccataaagttatggataccgctggagaaattgaactcatcggtaatgacaaaagtcttcacctggcgcaagttcccttctgtaaaggggtccggaccgaatgaggtgtacaacgagccttggtcaaggatgtccaccgtagggaatgttcccccttcgtatgtacgcggttcgttctgataagaataagtgaaacgcagggcgttattgatagccccccactttgagttccattcggaagcgatggaggtgaagttctgttcctgcatatagcgtgagctttcaaagtacagaccggtgtttgatgtacgtcccgaactgctcttgcccgcgctgccgtctactccgcccggataaatgattgaatccttaaacggggtggtggaagaggaagggctggaggaatacttggaatgggtatgggtgaaacggaaattaatcttgttgttgttgttgatgttccagtccagacggcccatgatcttgtaagaaggggtttccagagagtatccctgataacgtcccggattgtagttgtatttttccgacaggtattggctgatgttgttcatccctacgaaggtacggtcgcctaccgttgtggtgttctcgaacggacggtgcacaatgccgttggtgctccattcgtcattggcgccgctacgcgctatgcccgacgggcctgcctgcacattatcctgatattcgccgttcacgaagaagaacaatttgtttttaatgatcgcacctcccagagaagctccgtaggtggtgctgtggtcacggttgcgggtcagttcatagtcctctaccttgtttccggtgaggtgggtattggaagtgtacatataggctgtacctttgaactcattcgtaccactctttgtcacggcgttgatggcacctcctgtaaatccgctctgacggacatcaaagggggtggtggaaacggaaatctgttccaaagcatccagagagataggcgaaccgcctgccggcaagttcgagccgataccgaaggcattgttgaaagcggctccgtccacagtgacataagactggcggtagttacctccacccactgagaaaccgctaccgatattggctccctgaggggtcagacgcatgatatcgttcatgctgcggctcactgtaggcacttccgacattctggccgcatcgacattggttaccgctccggcgcggtctgatttcatgttgctgcttttggaagcggtaattaccacttcatccaataattcggtagattccttcaagttcgcatccaatacgtaattctctcccaactggaggttgatgctcttgtaaaccactgattgataacctacataagaaacttctactttgtaagggccgccggcacgcatgccctggatggaataacggccgtccacattggtaatggccccataatgggtgccggacggttcgtgaatagcctgaatcgttgcgccgataatggcttcattgctttgatcaaccaccttaccactcattgacgaagtggtgacctgggcgttaacagcagcagcgattaccaacataaccaccgcaaaaaaagatcgcattctttttaccataaactttttaattaattaatattataattaatgtcttaaaagacgttgcaaagatagctaatagaaacgatatacaagctacaaatcggttacaatttacagtgactggtctggtttcttccgctatccgcgccccagagagagtacacaaaagagggttcaaaacttaattagaggttttgatttgaaacttgaacctccttaaaggcaaaaaaaagagtcgtatcattactcaaaacggagcttgatacgactctttcaggtcttgtaattacaatctgttacttttcggaatggtcattttagtttggaccttatcaggacagggaggcccccatcagtcttccatcagcttgcggtagcgcacccgtttcggctcctcattacccagacgcttcatcttgttctcttcgtattccgaataagatccttcaaagaagaatacctcgctgtttccttcgaaagccaggatatgggtacagatacggtccaggaaccaacggtcgtggctgatcaccaccgcacaacctgcaaaatcgtccagaccttcctccagcgcgcgcagcgtgttcacgtcaatatcattggtaggctcgtccagcagcagcacgttgccttcttccttcagtgccatagccagatgcaggcggttgcgctcaccacccgaaagcattccgcaaagtttctcctgatcggctcccgagaaattgaaacggctgaggtaagcacgcgcgttgatatccctgttgcccagacggatcagctcgtttccaccgctgattacctgataaacagatttttccggatcaatatccttatgctgctggtctacgtatgccagtttcacggtctctcctacctcaaaagtacctttatctacggtttccagtcccataatcaagcggaacaaagtagtcttaccggcgccgttaggaccgattacgccgacaatgccgttagggggcagcatgaaattcaggttatcgaacaacagcttgtcaccgtaagctttcgccactcctttggcctcgatcaccttgttgcccagacggggaccgttcggaataaagatttccagtttctcttccttttccttcacatcctcgttcagcagcttgtcataagagttcagacgggcctttcctttcgcctgacgggctttgggagccatgcgcacccagtccagctcgcgttccaaggtcttgcggcgtttgcttgccactttctcttccatctccatacgtttggtcttctgttccagccagctggagtaatttcccttccaggggattccttcgccacggtccagttccagaatccatccggctacgtggtccaggaagtaacggtcgtgggttacggcaatcaccgtaccttcatattgctgcaaatgctgttccagccagtcgatactttccgcgtccaagtggttggtaggctcgtccagcaacaggatatccggcttctgcaacagcaggcggcacaaggccacacggcggcgctcacctcccgagaggttcttcaccggctggtcttcgggcggacagcgcaacgcatccatggcgcgttccagtttgctgtccagattccatgcgtccgtagcgtcaatgatgtcctgcaactcagcctgacgggcaaagagtgcatccatcttctctgggtcctcatagtattcgggaagcccgaacttgttgtttatttcttcgtattccgccaaagtgtccacaatgctctgcacaccttccatcactacctctttcactgtcttttcattatccagatgcggttcctgtgccagatagcctacagagtagcccggcgagaacaccacttctccctgataacttttctccagtccggcgatgattttcatcagcgttgacttacctgaaccgttcagaccgatgataccgatcttagcaccgtaaaaaaaggataggtagatgtctttcaatacctgtttgttcgcctggaaggctttgcttacgcctaccatcgaaaagataatctttttgtcgtctgccatattctttatattattaatttatttaagttgctatatttttactccgacagctggataaaccaacatttgaaatcatcatcctactgtttttcctccatttttctgtaataccacggatgtgtaaagaactcatacatcagcaaaagagtgacacagataccgatacatatccaataaatagtatcaggatgactttcggtccacatattctcaaacagaaaaccactcagcatacctacttcccacatcagctgataagtattgtttcccgtaccccgttcgcaatgcatcggcagactaatcatctttataaaaaaccgtgacacggtagtaccgatccccgtgcccagcaatacaccggctatataactgttcatcaagctgttggaaaaagcaagcaacaacagtccgcctatcatcgcggcctgccccagctccacctccgaacggccggaagcataggaaagcacataacgcaaaagcaacagggagatgataaaaccgatcaggatgcaaatgtaaaacaactcattgtaaatgtgcgctatcaaaatgccgaaaacagcggaaagcatcatcatattcagtgccggccacagagtacgaggcaacagaaaacggtccaacgagaaccatgaggtgcgcagcggagcacggaaagggacatccaccgccagaatcagaagcaaagccagtgtgcccaaagcgacacaagtataaacaacatggtgaaaattccagtaaggataaatgtaaattcccaacgcaagacctgccaccattccaaaacgccccacccacgaaaaggcgatattcgcatccgtgcggcggcgtgaggcggtgacgtcaatcaccagcgtgctacccgtagtcatggtaatgacactgaacagccccccctggacagcccggaccaaggctatgaaccctacagtcgcaacgtatggatacagcaggctggacgccacgaacagaagcatcgcgaccagacaaacacttttacgcttgaacgtatcgataagatagctgttgaacgctcccggaagaaacatggccagtccgaaaacagccacagccgctcctgcttccgcatagctgcaataccagtgccgcaccatccataaaggcagtgcgggaagcatcatgtatagcgaggcataaagcaaaaagttcgaaagggatagcagcaccatattcccggtccacagttttgctttctcatacggaaagaagaagtcatcatacatatcagcagaaactttgttaatattgttcgtcttcgttaggaaaatcaccttttttcacatcatccacgtattgctgtatagctcctgtcataacagtatgcaaatcggcataacgacggaggaaacggggactgaaaccgttggtcatacctagcatgtcggatacaaccagcacctgtccgtccacagcgcctccggctccgatgccgataacggggatagtcagttccttggccacacgttccgccaatgatgcggggattttttcgagcaccaacgcaaaacatcccgcctcttccagcagatgcgcgtcactcagcagcttttcggcctcttcctcgtccttggcacgtacagtataagttccgtatttattgatagactgcggcatcagtcccaaatgtcccatgatgggaatacccgcagcgatgattttctttatcgcatcaatgatttctacgccaccttccagcttcaatgcatcggcatgtgtgatcttcatcactttgatcgcattggtcaccgcttcgtactcggaagtctggtaagtaccgaaaggcaaatcgaccacaacgagcgcgcgtttcactccacgaaccacggatttcccgtgataaatcatctggtcaagggtgatgggaagtgtggtcacattccccgccatgacattcgaagcggagtctcctaccagtatgacgtcgatgcctgcgccgtctacaatctgcgctgtcgtgtaatcatacgaagtaagcatagaaatcttctcgcctctctgcttcatttccaccaaacggtgtgtcgttactttgcgtgtatcgcctgaaatatatcctgccatatttactttaatttataaaaaacggctgcaaaggtagatgttttagttgacattacctcattatatccttcattttttcgaaactaaatccattaaagtcctgaataacagcctttgccttatcgcgtatctgctcttcagggttggtagtagccaatcctatcacggtcattcctgcccgatttcctgcctcaagcccgtgaaatgaatcctcgaaaaccacacagttctcgggcacggtatcaaagactgtggctcctaataagaaacattcggggtctggtttggaacgagtgaacatttcggctgtgaggatacggtccacactttgtttcagttccggatgtgctttatatgcgttgttcatcttcatttcatttgagcttgtgactatcgctatctttaccccgttggctctcagctccttcataaagccctctacgcccgggatataattaaataacatattttcttcaaatttgttcaaatcttctgtaatttcacgctgaacgtcttccattccagcgaaatatttgttataaatttgtgtcaatgtctgcccttttatcatccggccgaactcgggtatctcaggatggtatttccgtccttgttcattccagaatatactatactgaggttccgtatctaccaccaccccgtcaaaatcgaataaagctgcaatgctttttgttgaattcatattacttttagtttgatttaacgccgcaaaggtctgaataatcctccatattcctaactttgcaaagcttaaaaataataaaaacgcgaatgaaagaaaacaacccgcacatactgggtacagaaaaggtaggaaagctgcttttagagtactctatccctgctatcatcggaatgacactgacgtcactgtataatattattgatagcgtatttatcgggcacggtgtgggggccatggctatctcgggactggctatctcctttccgctgatgaacctgctggtggcattctgcacattggtcggagtgggtggggctaccatatcgtccatccgtctgggacagaaggatacggacggcgccgagaaggtgctgggaaacgtaacggtgctctgtgtgataaattctattttctacggaggcatcaccttgctgtttctagaccagattctgttcttcttcggggcaagccatgacacgttgccatacgcccgcgactttatgcagattatattaataggaagtcctgtcacctatgtaatgatcgggctgaacaatatcatgcgtgccaccggttatccccgaaaagcgatgctgtcctccatgctgacagtggggtgcaacatcattttggctcctgtctttatattctggctcggctggggaatccgcggagcagccacggcaaccatcctttcacagtttgccggcatgatatgggtgctgagccatttcatgcaggaaaaaagttatatccgtttcaagaaagggatattcaaattaaggaaacggatcgtagagaatattttcagtatcggcatgtcgccgttcctgatgaatgtctgcgcttcggccattgtcattatattcaacaagagcctgctgctctacgggggcgatctggctatcggagcatacggcatattaaaccgtctgctgatgttgtttgtaatggttatcatgggactgactatggggatgcaaccgattgtgggctataatcatggggcacacaaattcggccgggtgaagcagacgttgaaatattgcatgattgcaggggggtgcatcacttcgctgggatttgttttcagcgaacttttccctaatttggttgttaatatgtttacagacgataaagaacttacagcattggcacgcactgggttgcaaatcggagtcctgatgtttcctttcgtgggaatacaaattgtgatttccagtttcttccaatctatcgggaaagcgaaaatttctatcttcctctccttgtcccgccaactgttgtatttattgccctgcctgctgttgctgcctcattggtggggactgaacggcatttggctcagtatgcctgtatctgatcttttagcatttatcacagcctgcctgatgctggcacatcatattaaaaaactaaacaagatcacagaagtatgatatttaatgcagaaaacattctcttgataggttctatcctattgttcgtaagtattgtagtgagcaagaccggctatcggttcggaatccctacgttacttgtttttttattggtcggcatgctgttcggaagcgacggcctgggactccaattccatgatgcgggcgaggcacagttcatcggcatgatggcccttagcatcattctgttctcagggggtatggataccaaatattcggatatcaagcctgtattgccacaaggcatactgctttccaccttcggcgtgttgcttactactattttcaccggattctttatttattggatttccgggttctcgaatgtcagcattaccatgtccctgatgacggccatgttgctggcggctaccatgtcctctacggactctgcttccgtgttcaatatcctgcgctcgcaaagcatgaacctgaaacataacctccgcccgatgctggaactggaaagcggaagtaatgaccctatggcgtatatgcttactatcgtcctgatacaatttatcacatcggcaggcatgggggcagacgatattctgatttcattcctgattcagtttgctgtgggtggcgcctcaggattcctgctgggaaaactggcggtagtaatcatcaacaagattgacttgaagaaccagtcgctctatcctatcttgctgctgagctttattttcttcacattcaccatgaccgacctgtgtaaaggaaacggctatctggctgtctatatagcaggaatgatggtgggtaacgcacgcattgtaaaccgtaaggagatcgctacttttatgaacggcatgacctggctcttccaaattatcatgttcctgagcctgggattgctggtgaatccccatgaaatgttgtccatcgccataccggcaaccttgatcggcattttcatgattgtactcgcccgcccgctcagtgtcctgctctgtcttcttccctttaaaaagatgaacatcagctcacggctgtttatttcctgggtgggattacgcggagcagtacctatcatattcgccacttatccggtagtggctgatgtgccgggatctacccagattttcaatatcgtatttttcattaccatattgtctttagtggttcaaggaacgaccatttcatggatggccaaattactccatctggatacaccactggaaaaaacaggaaatgatttcggagtagagataccggaggaaatcaatacagacctccgcgatatcgtactgacggaggaaatgctggcaaagggagacaggctgatggatatgaatctgcctaaaggtatgctggtgatgctggtaaaaagggggaacgaattcatgatccccaatggctctctgcaactgcatgccggtgacaaactgctgattatctcggaaagcaaaacgaaataaaaaatttgcccatgtgcccacgtgctgcgctatggtcccgcatggcaattggcacatgggcaaattcgcacattattcaactgagcaacagcatgatattcaatgcggagacaatcaccgcaatggtataaagcacgaatgaactccaccgggagttggcatatttgcccatcacccgtttggaagaggtcagtcctacttgcaggaacaccgtgaaaggcagctggatactcagaatcatctgagagatgataagtccgtaaaagggattctcaataaagaaaataagaaccaatgctatccccaaagaaatcaaaatacctaccttggagtgaatatccttgatatgataagattcaccgaaaatacccgcaaagatagaacctgccgccatgccactggttatggtggaggaaatccccgccatcagcaatgccagggcaaaaatgattccggcatggctgcccagcaatgggtcaagcaacgacttcgcctgctgcaactcttccaccggagtccgggtacggaagaaagtagcggctgccagtaagatcatggcactattgatagcccatcccacaatcatggagaacaaagtatcatagaactcatatttcaatactttacgaatggaactctcgtcctgcttgttgtactcgtggctctgtatcacctctgaatgcaagaaaagattatgcggcataaccactgccccaagcacactcatgataatcagcatactgccttggggtatgtcgggaaccacccaggaacggaccgccacaggccagtcaatatctaccaaaaacaactcatacagaaacgaaaggccgattacggatacaaaagcaatgatggctctttctatctttttatatgaattggaaaaaagcataatgacgacaaacatcgtagtaagaacagatccccaggctatgggaattcctaaaagcatctgcaaggcaatggctcctcccaatatctccgccagcgaagtggatatggaggccagtaccgcgctgcccaaaatgggacgggatatccacttgggacaatactgcgtggctgcttcactcaggcacaatcccgtcacaatgcccaggtgggccacattgtgctgcaacacaatcaacataatggtagacagggtcaccacccacaacaacgcgtaaccaaattcggaaccggctgcaaaattcgaggcccagtttcccggatcaataaaacctacagtaaccagtaatccgggaccaatatatttaaagaaatcaagaccacccagataacgcttgtggtccgtacgttttaattcatctataatgcgagacatgttttactttttttgtttgcacaaacttactaataaaaaacaaaaatccatttgctttgttcaaacttatagtttactttcgcttcaaaataccgatttataatgaaaagagaaacagttataatagcggccctaggcatccttactttggcaggatgtaataataaccaccgttcacaagtccgtaaattcaaacagacagccgaaaagaccaaccggtcctgccccacacgtatgaacgaaacgattacactggacagcacccgttataatgagaaagataatagtgtgagctatttctacagtgttacaggagaactggacaacgccacttatatgaacacccattatgccgcctttaaacaagccctgcagaatgcagtagacaactcggtggaaatggaagaataccggaaattcggtacttccatccgctatatctattattcgggatcaagtaaaaagcaactggctgcattctccttcaattcccccaaatagattccgtttcagcccatccggatgcatgataccacgctatggaagacttgaaataattgttccaaagcaaatatttgggagtggtgaatgaattggggatatacatacccattccactgtagttatctccatctattctgtacaaggatgaggtgggatcatgagtataatctgtataaatgaccgtcttctttaattgttgcgtaaaatcgtctggagccattcctccacacaatttttcaataaactgtaacatatcataggcatatcctttgaagttgctgctgcctttgccatattgctgcaaatcagctatatccacgttcttcaggctatcctgattggacaaaatcacacttctgaccgcttccgccaaaccttccatctgattgcaatccactgccgaaatggttccccaaccattatagttataataatctatataatctttacagattggcttcaaatactccttgatcgcattttcatacaaataaggcatcacacttgcataaggaaatccggctgccggtatatcaagtacagaagcgatgcaatatttggcagcatccttcagctcataatacacttcggcacaccccatcatacacgcatcaaacaagacaaaatcaaacttttgaggatttaccgtacgcagcacttccgccaattccggtatcaacgctgtgtcactggaataccggccgccatcttgacctatagaacgggtgccggtaatagtgggcaaccatcctgaaccgtgagaaccaaagattattccataactttccgacggataaacactcatcatatcacctatcactgtctgcatgacggttttctccgtcgatgtctgaggggaatatttttttctgatattgccaatacttatcaagtcgtgaaccgacatgtcctgatccgcgatcatcgcattgaccgcttctttggacatactgttgatcctcccttgaccattagtcacatattcaacgatacaaggctccggccaactgatatccgaagcctcaccatcccaatataccaacaaagcagccgaatccttcatagcctgaagcccctgcatcatcgtccgaatattattacgcaaattggaattcaagctgttatccgcccaaaagaaagccaggaccgttcttccggcatgttgctgaggaatcacgattgtttccttctcgcaagagaagaaaaagcaggctgttaaaaatataaatagaatctttttcataagaaaaggatcactcttccggtttcttgaacttgaatgcattggggttcacttcgcgaatcagcaaggtctttcctttttgatacttgattttcatcttattgatggtcttctgcagtttctttctgctgttcgagaaataaacaaagcaagtgcggttcgtcagcccttcctcgttttccaaataatttttcagctgataactgtattgtgagcgctccggcaacatcttattcttatccagccttacactgtccagcaattggatttccgtgaaataaaccaatgaatctgtaaacgatgcggatacacctactatataaacggatttacctttacttcctttcaatgagaatgccgagcataccatcagtaccaataataaagagcacagaatctttatggatttcataattctaattttataattttattagaggacaaaaatagttatttacggacaaatacgaaaaagtaatagattaattaactataataatttgctgatgtgcccattaccatgtggcacatagcgcagccaatgggcattattggtatattatgaacaaaagcacaagacgggagtaaccttccatcttgtgctttgttttcttttcggaaaccgaatctttcttaccctaaataagacttaagcagcttgctacgcgaattttgtctcaatcttctaatggctttctctttaatctggcgtacgcgctcacgagtgaggccgaatttatcgccgatttcttccaacgtcatttcctgcgtattaataccgaaaaacatctggataatatccttctccctttcggtcagcgtagagagtgctctatcaatttccctcgcaagtgactcattaaccaaggaacggtctgccataggcgagtcgtcgttcacaagcacatccaacaaactgttgtcttctccttccacaaaaggagcgtctacagaaatgtggcgtcctgaaaccttcaacgtgtccgagattttgtctacaggtatttccagttcatcggccagttcttccggagaaggacgacgctcgttttcctgttcgaatttagagaaggctttgctgatcttgttcaacgagcctacctgattcaacggcaaacggacaatacgtgactgttctgccaatgcctggagaatagactgacgaatccaccatacggcgtaactgataaacttgaagcctcgggtctcatcgaacttttcagctgctttaatcaatcccaggttgccttcattaatcaagtcaggaagacttaacccctgattttgatactgcttggctacagacacgacgaaacgcaagttggcacgtgtcagtttttccaatgctacccggtcgcctttacggatacgctgagcgagctctacctcttcctctacagtaatcaggtcttcacggcctatttcctgtaaatacttatccagagatgcgctctctcggttagtgatacttttggtaatctttaattgtctcattctctataaaacaaatttgggatgcaaatttacaacattaaatggaatacatccatttttgtttgaaaaatattagctaataaatcaaaaaagactatctttgtccttcttttcctaaatattttgcgaaaatagggttatatctttctctttattgatcttatcagcttacttaatagagattattccatgatatagcgtaaggatggatcctgtcaacagctcttatcttatcgtgaaacagaattgatttatgtcctccgttttccggccggacgagaacgcaaacacctatgacgcaaattaatagttacacgactctactatcggataaaaacatactaaaaatcaaacttgtgttcccatcatccccgaaattccgtttacaatgcttctttccagcatatcaatcctgtttgactataaaatcaggatgcacggaagtgtcccttaccgtgcatcctctaaactttacctattgaaactttctaccttaaaaatatccttattcctgtatcaaatctactgcatagttcgcacgtttacctgacgggaacataccgctcaagaacaatacctgatccggtgactgggtagcagctttcagcacatcttccaaatcatttactgatttgacaggttgtccatttgccttcaggatgatgaagcctttacggataccggcagctttcattttaccgtctgtcacacctgtgacttccacaccatatcccaagttcaattgtctcttcaattcctgaggaacttcacggaacgctgcgcccaagatatccatgcccgcactcttcaccactttcgttgttccctgtgcatttttcaaagtcatctcgatatccttttctttcttgtcacgcaacaccttgacggttactttgtcacccggacggtgtttagccaacccttcctgcaactctgcaaagttcttcacacgttttccgtcaataccgataatgacatcgtccacttccaagttaccagccgcagaacctccatcaatcacctcagctatcagcacaccatcggtagcacccagttccttcactttcttcttgatttcttccggcatcatctgctggtcatcattaatcggagtacccttgatacccaataccgcacgctgaacggttccgtattctttcaaatcggctattacctttttcataatactggtagggatggcaaaaccgtatccggaataagctcctgtcggtgaataaagcaccgagttgatacctaccaactctccttttgcattgaccaatgccccaccactgttaccttggttaatagctgcatccgtctggatgaatgactccacaccttgattatatacgcccaaagaacgtgccttggcactcacaataccggcggttactgtagatgtcatattaaacggattacctacagccaatacccactcgcccactttcaaagcctccgaatcgcctacgggaatagtgggaagttcatccgcttcaattttaaccaacgctaaatccgtgctgggatctgtgccgattacacgtcctttatattcacgtccgtcattcagtttgacactgatcacatcagcattatcaattacatggttattcgttacaatatatccatctttcgagatgatcactccggaaccgaatcccactctttcaggagtctgcacctgacgctgctgaccgccgcctctgccattcccaaaaatatcaccaaagaaatcatagaacggatcacgaacggtaactgtctgagtttttgattcttgagttgactttatatgaactactgcatgcactgaattttccgctgcctgagtcaaatccaccggttgcatttgggtggcgtccagcgcggcaagtcttgtattcggattttgttggaacacatcattaaaggccacgcttttgtttggctcgggtttcaacatagaataagtcgttactcctgctacacctgcgctgactgctacaattgctgctgcgcctagtaccattttagttgcttgtttcataacttaatatctattaatttgttaatttcaagtttggtttaacatttctgacgctaatgtaatgacaaatattgtacggttgtaccgtttgtcagagatttttttcctcttttaacacagatagataagcacttaacaggggttaaccgcagaatctgccaaatttgcattcattatcaatagctgacagacagcaagatgacacaggatacaacttgcctcatagatagttatgtcttgcaggaaatacttgcctcccgctggaatacatccatatacacccctataaaagggcatgtccgtgaccggtctttctaactttactttttcaactggttcaatacccttctcgcactatccgaaagaacaacaacagctcctgccaaaatagcagtatctttaatgaccagacggccggcgcccgtcagcagagggaacccctgttcgccacttcccaaatcggggacccacacctcaggcgttgtcacaaggaaagacaaagtgcccagtgtcatgacaatagccagtccggcccctaccaaaccgattttcggagagaagatacctaaaaacgtcaagataccgattcccataatcaaaatacccaatccatgagaaaacccataagtattgttctcttcatgccactggtgcttcgcttcatcgaattcgccttctttcagcttatattctttatattcaggagcgtccttggtataaaagaaactcataaagggactgttcgccacaaaaggcacaattccttcggcttcataattccagaatttcagaccgccaatccatacaaaaattacaaggattgccacacggataagattgatacccagtttttgggcagatgctgctattgttaaaaacgcaacaaacagagattttaattttgtcatcattgctttcattattaaaagatttaacttcctggtgcaaaggtcggcagttttccctctccagtaaatggcaattcccccatataggttggcaattattcccgtttctctcttttccggtattccgaaaggctctccttgttcattttcttaaagaaccggctaaatgtagccaaatcctcaaatcccagaatctcactgatttccttcgcactcttgcccgtataaagcaacaggcgcttggcttccgcatccacgcgttcatgaatgacacgcaaaggagaagaaagcctgtaaagggaaaagagattggaaatggtcttgggagaacgacacaacatatcagcataatcctgcacttgcttcttctccttaaaatgactgtcaaccagcacataaaactgacgaatcacatcaaacgtgttctcacgccccgggtctacatcaaacatttcacgggctatgcgggtacaagtgataatgaaacgtttcagaataatacgcaacatttcttcctgcaagttgtcttgtatttcacactcccctctgaaaatatcgacaatactgtcaagacgggccgactgggaaggcgaaagcttcaaacgcatgacacgggaagaaccgttaaacaggaatccgttacaagacacctcgctgtcatgcccgtaaatacaataaaagttactattgaataaaaaagtgaggtattcaccgtccactccccttatctgcacatgatgcaaaggagtgagcgaaatcatttcctctttttccagatgcatcaccacatgatccacttccacatccagcgttccatgccgcacccatataaatttataaagactcccgtcacgttgcaaaaaggagttttcatggaaacaggaagtcattgctatatttccattcaatttagtacttaagtgatattccataactaccttaaaataagatgaggggataaatataaagctatctcttcagatataaaagagataacgcaaaagatatttctcatcctccctcttttcctgcctttcaccggcattttaaatcattgccatataagttggccaaagttcccgtttaaaatgttcacacctggacatacaggaagttccccacttcagtgcgtttcttttaatatttgttaaacatttatttttcttcgtccactccctgatttaatagtacatttgtttcatcacaagcatcagagcgatatatttaaagaagagtagaaaacaataatggataaaaatcgtaggagaatccgtataggctatattcaatggctgctgatatatacctatatatgtaccatcttctcattcacctgtgaagctgccaatgcacaggatcgtaccgggaacgaagaatatgtgctgattttaaacagctataacgaatcttctccatggagcaacagcattaccacccccattgtccataaactagccggaaccaaaaatatagacgcctacatagaacatctgaatttattcatggtaggcgattctgctaaaatagaaaagttttcagaaacactttcctcaagatatggctccacccctccccgtctattggtatttgtaggaagcatgagtctgattttcagagaagagatacaagctttatggggtaccgtacctactattgtctgcggggcagacccctatgtgtatcctgaaatattctacaggcagagagatacagtcactcccaaagaaaagacacacatgagcgaactggcccaagaatacaatttcacctacatgcatacccctatctatctggaagaaagtgtggaactgatgctgcaaatgattcccggcatgaaaagactcatctttttgggagacgggatttatcccaatcccgaatatgaccaacgactgcgggaattgatccaaacaaaatatccgcaactggaatataaatacatctcttcacgcaccaatactctgcaccagttatataatgctgtacgtaaggcagacaagactacaggcattctggtatccacttggttcaccgaatccttcacctcggacagctttctgataaacgcttacagaagcatttccagcatctccgcccctcttttcaccatccgctatgcaggtatggacgacggaggtatggtaggaggatacatgtacaatgaacaagccttcaccaagcaattattgaaaacaattgacgacatcctcggtggaaaaagagccagtgacattcctttctatgagcctcaggaagcacaccccaccttcaactataccagactcataaataaagggctcgaccccaagcgatgccccgatgacaccattttctatgacaagcctgtccactttctgaacaaatacaaatggtttatcctgattgtgctcatggccttcgcactgatggctgtaacacaacaaaaacgcattcagatgctgaaagtcctgagacgagcccaacaaaatgaaatagaaacaaacgcacaatatatcaacctggtggataatatgccgattctttacatgaaggaacaagtaatatgggataaagaaggaaatattatagacagcatttatcaggatgtcaaccgttatttcgaacgatgtttttttaaaaaatccgatataatagggaaaagggcctccgaaatctttcccgaatctttaccggaattcacccatttcatgagtatcaccttgaaagaaaagaaatcgatcacattcccatattattttaaaaccgtcaacaccttctatgatgttgtcctgaattgctccactgaaccggatatggtcgatgtgttctgcatggacagcaccgagttgcacaatgcacagcaaatgctaagcgccacgaaccataaactttccatggcactggaagtagccaacattgtaccttggaaatggaacttgaaagaccataccatcttgtgcgaccttaaccgccccattgccatggcagccatgccgggcagcatcagcgaagatcagttgagcgtatcggacaaacaatatttcgccaaaattatcaaagaagaccgtccacgcgtgatacaggcctaccgcgacctggcagacggaaaaatagagaaagtgaaagaagagtaccgtgtactggccaatgatggaaaacattggaaaatagactgggtagaagcacaagcagccgtagaaacaagagacaaaaacggaaagccgctgactttagtcggttcctcactgattatcaacgaacggaaaacaatggaaaacgaactgctttcagccaaggaccgcgcggaagaatccaaccggctgaagtccgctttccttgccaatatgagccacgaaatacgcactccgctaaatgctatcatcggtttctcaaacatccttgctactgcagaagaggaacaggaaaagcaggaatatatcaatatcattgaaagtaacaatacgttactgctgcaattaatcagcgacatactggacttatcaaaaatagaggccggcacactggatttcagttattccaacgtggaactgaatgatatcctttccgaaatagaaagcgtggtccgttaccggacggaaaccagcggcattcaactgattgcacacaaaggactcccctcttgccccataaagacagaaaagaaccgcctgatgcaagttttgaataatttgctgaacaacgccagcaagtttacctcacaaggaagcatcaccttcggctacgaactatgcggcagagaactttatttctatgttaaagataccggttgcggcattccagccgacaaagtgaactccatattcggacgtttcgtcaaactgaactcttttgtacagggtacaggactgggattatccatttgccagacgattgtagagcacatgggaggacgcatcggcgtagaatctgaagaaggaaaaggatccactttctggttcaccattccctaccagcccgctgatacggataacaaaaaggaagacaaacatcagcccatctccgtgcagaaagacaagctgaccattctgatcgccgaagacaatgagagtaattaccggctgttccaatctatcttgaaacgagaatataacctggttcatgcttgggatggaaaagaggcggtcaatttgtataagctccataatcctcagataattctgatggatatcaatatgccggtgatggatggctatgaggccacccgggaaatacgaaagctatccttggatgtgcctatcatcgccgttaccgcttttgcctatgccagtgatgaacaacgggttatggaaaatggcttcgacggctatatggccaagcccatcagcgccccacaactgagacaacagattgctgccatattacagaaacgcattatcttattataacctccgctttttccattatacccggctgaaatccgatgtagaaaccggtttgaatccgcaactataaacaagaaaacgaccgaaagcgccacaaggatggagaattaaagatgattataacataaatgcagagttaattcatcgcttcagctccattaagtctttttttcagtaccattaaagcatttcttacggttaccttttacagactacgacagtagtccgtatgtttcactacggcagaccgtacagtccactgtagcagactgtacggtccactgccgaagactatagtaacagtccgcacaaaaagacttaacagtccgtatgacaagacctgatatacccgacaaaaagtattaacccccatacctaaaaaaactcccccttgctcaccttcacaggctatgcaagagggagattctacactaactcttaacctaataaataaacgacaaaatcattctttatatcttaaggctccggctggcagtttctcacctttctcaccaaagctcttcaatgcgttttccgattcaatggttactttactttcatccaacattctccggtcaaggccgaacacgtctataaagaaatcataaaccgcattccgcttgttcggaccgaaatcatgacgttctttcggcaaatgtacattgctcaccttgtccgtcgcaccataaaaaccgtagatgcgttgcaagtaaggatattccaaacgaggaaccgtggctgtccagtctcctccgtcggaaaccaccagcatgggacgcggagcaaacagggcggccagttccgcattgcaagttcctccacctgccagctggatgggcttgccactttcacacgggcaaccgccatcaaagtgagaagccagactgaccacaggggcagcagctgtaaaacggtcgtccaaaacggtaagcaacaccgtctgcgttcctccgccggaaccaccgttcacgccgatgcgtgcaggatctatatctttacggtttgccagcatatcatccagtatcagcaatccgttcatagcctgaatggtgtgcgcatcactggtatggtgcgcttccgcacctacctgcaaagcggattctccccaaccatacaagtcataatccacacaaatagcccccatacgcgccaatgtagccatacgttgctgttggtccttccggtagcgtccctgtccaaaatggccattggggcaaataataagtgcatgtttacctttggaacgcggtgcataaaccgaaccgcaaacataaagccccggcaaggtctccaatgcaaaattctgcacggtatatccatcgaatttccgtactttcgagagaataggctttgcatccttcactgttcctttcagcatatcatccaatcccaaacgttggcgcacttcctttcggagtatctccctgcgctgttcccactgatctttatcagtatacaagccactaagatatgacaacattttttctccatcaacatccgtgcggcgtgcatactcgtatggtttcaacttgtacacggtatcactttgcttcacgaatttataatcgaaaggagaaagcacattggtcaaggtttcttccaatgaatagggacggatacggaaatcggcatacggaaggatacgccctaccgtatcaatatcatacttcaagcggacctggaaacgggcggcaacgtcattcaacacatcggataacggacgtgcgaaccgggtttcataagtttgtgcagacacagcggaaaaagagagtgccgccatgcacaaaagcatctgttttttcatcgggcagtctattttatttctttaccatccacatacacatcatccagcaccaagtccttacaatcttcaaagacacagcgttgcttggcattctgaatatacacatcacgcatcacaataccggtaataggcgcttcgggcaggcccaccaccataatgggggtattcacatcacggaccgtcacacccgaaacatagatgttacgaaattccggagtgcggtcactcttcggttcggcaggcatcttgctatatttcagattgagaacaatagcttctttcttgatattactcatcacaatattgcttacacggatatcctccacaatgcctccgcggccacgagtggatttcagacgaatccctcggtctgtaccatcaaagacacaattgctgatggtcactttcttcactcccccactcatctcgctgccgataaccacaccaccgtgtccgctcaacatggtgcaattggtaatggtgatattctcgcaaggaacacccagtttacgcgcttgcaagtcacgtccggatttgatggtgatgcagtcatcgcctaccgaaatgtggcagtcgctgatgtgtacattcttacaagactcggggttgatgccgtccgtgttgggggaaggcacattgtggatggtaatgcctttaatggtcacattgtcgcaaaattcaggatttacagtccagaagggagagttgataatcttcacgccctctacccgtacattcttacaacggatgggatgtatgaaaggaggacggaaaaagcgacggtccagtgtgccatgccagtcttcattggtttcagcgtaaagggctttcaggtcgttttccttctcgaacatgggctggtacttgttgatgtttctcttgccgttatctctaaggtctaccagtacacggaaaaattcagtccaccatgccttaccctgtccatccagagttccttctcccttgatggtaatattttctgcatccacggcgtaaatcaacggttggaaacttttcatcatgattccctcatgacgcacttccacataagggaggaagtcgtcaaagttctccgagaatttcaaggtggctcctgcttccaattctaatgtaatattacttttcatgtggatggaaccggtgagataagttcctgtggggaaaaagagtgttccgccaccattggcattcaagcggtcgatggtagaattaatcaatgtcgtgtttaatttccggccttgtatatcggcaccggcttgctgcatatccacacgctcggcatgcagaaaagacaaactgcaaacacataacaacagacttaaaaaggtacgtttattcatatcgttcattaattgattttagttttaccaaacacccccagggggcttttcctatgaaagctgcgtttatttcttaaaagaataagttccgctttccactatcttcggctctttctcattgggaaggaatacgcgtgccgtacaccctacaggtatcgttactttcaatgtaaagactccattctcgcgtgtccagtctactgcaacctttccatagagagtttcagtcgaagcccggacgtatgtcaaatcgcctaccggacggggacgtatttctatttccttcattcccggttttccctcaacggtgcggatacccgccagcgagttgaagaaccattcatcaatctgtcccatcataaagtgattccacgaagaaccttgtcgcggatcccattgctcggtcagcgtggtagctccaaatttcagttggaaaccataccccggggcctcttcatggttatgcatggtgtacatcaactcattcagtccgttacgggctagcgtctggaacaaataacgatttcccacatcaccagtagtcagccggttaccatgacgttttatatccgctaccaagttatcaagtaccgcctgtttatcttcggcaggaaccattccgagaaacaacggcagggcattactgcactgacttcccgtaccatactgacgagtatccttatgataaaactcccgatggaatgctttattaatttcttcacccaaatgagtgtaatatgctacatcatacctattatccagcatacgtgccgcctccaccaaatagcgaacaaccatataataatgggcggtagctactaaaggaacaggcgtattacgagaaaatccggcccggaaatctccataatcataccaatcacccagtccgaaagaaacgattccatcattggcacgggtagtcatataatcaatgtaacggcgcattccgttatagtattttctaatcaatgaatcatccccatacgtctcataatacatgaaaggcaataccacaaaggtacatccccattcgggagattcggcaaaagcatccataccgggaccctcgaacaccacatattccggagcagtggtaggaaccgcgccattggcatgctgtgcatcggctatgttctgaagagtctgagggacaaagcctgtcaaatcataattgtaaagcaaaccgggaccacacaaatgatcttgttccaaccaacccagtttctcgcgatgaggacaatcggtaaacacggactgcatattgcttcgcaccgccttctctatcagccgatgggcctcattgaatatacgattggaacattggaatgtggataccttaggagccgaattataaacaaagcacgattgtatcttctggatcaccggaagatgcaaggtgtttttttgccctttcagcacagcgccttccacctgaatataccggaaaccatagtaagaaaaacgaggatgccaagtttccactccttcccctttcagggtatattcataataatgttgtctgccggtctgacgctgattgcaagctccttcgtccgtcagggattcggatacaagcagagttattttctgccctttctttccacggacggtaatttcggggaaaccggccaggttctgtcccatatccagcacaaaggcagacggatctactgtccgtttggttgacttgcaggcagctgttatctgttcagcggtgagcttggtcattttccggatatcataacgctccataatcttcaccggttgcgctatctgcggacgaagcacccctttgggggcttcctgaatcacgacaggacgccaatcctgctctttaaaaccgaacatgttccagcctttctgctcacggcgggcgtcataatcttctccgccatagatgcaattgaacagtacgggactgaaatcgtacttccagtcctttccggaaacaatcgtttcactggttccgtcttcataattcaccaccatccggaaacgaagcgtgggagcgccgaaactgatttgcagtttacgatagcggccgccttgcacattgtaaaatccatttcccagcaggactccgatagcgttaccgcctttcttcacttgcgaggtgacatcataagtattataatagacacttttgtcatagtcgctccaaaggggggcaaattcgctgtctcccactttttctccattcagcgaaaattcataaaagcccaagccacatacatacgctgtggcgtctttcactttctttgccacatggaactcgcgacgcagataaatacttttctttgccaaagtatccacagcagcccaggcggcctttgcctcaggctttttcagctcactgccatgatatttccggccttcgggtatgcgggcatccttacgggtaatggccccaatccattcactgccggcgaaagccgcttcggaagtcaggatactgaaatcagagggcgcactccatgccgaaggcgtatcagcctcatcccagacacggacacgccaagtataatgcctgtccttctccaaagccgcatccgcacaggaaaccaactggcttcgagcggattttactttgccactgttccagactacttttcctgcccatacatcccgaacctctatctcataagcagtctgccgcgtgccattttccggcgaactcatctgccatcccaaacgaggggcatcagagatggtcactcttccttcgcgcatctcacacgtcaggcgggtaatagttatgtctttcgcctgcacggagaaagacataactaacaaagcggctattaagaattttctgtaattcatttttctttcaacagtctatttattatcttaagacatcccctttattcaaaattatagcacattctcacaaagaacacgggtcaatgtatcggcatgtcctacttcctttccatccacatagatatgcagaccttttccacgctggtaacggctgccgtctttatcccacaaaatagtgaggttacggccatgatacaacacattatccaaacagaaataatcccattttccttcgggaatcaacggattcacctccactgtgttatccatgcgcggacggagtcctatcaaaccggtaatcatcaaatcattaaaagtagaatgattgtaataacggctgcgttcctgatcccctttcaaccaataaccggttacctcatccagatactcgccgatgtagggacgcccacgatgatgttgcgactccacatagcgttccatttgatggaaatacacgctgtctgtcaatacagtctgaggataattattcatgaaattggccattgcagtcaaagtctgtgcagatgcaaacggccagatagccccatcccattcacacttacctacgccatgcgtacggaactcaggatgacggcgctcggcagtggtaagtccgtaaggtgcggaaaaacctttctcgtccatcacttccttccatgccacatcgtattgggaagaagcatccggcaaattgaaataccaagggatatagccgatagcctcgcgtacctcggcggacgcatctccacgcatcgtttcaaagaaatggtggtctgtgttccacaacttatcctgtaccaacgttttaatggagtcggctttcaatccatatttcatggccatgccctcatctcctgtcatgatgccgataagagagagcgctttggcgttgccatacatataactgttgatagtaggacgggcatattgcttacgacgacctccactgatagattcctccatgccatcctgcacatctccctgccagtaaagtccattggacaggcggtttgtcttttcccaacgggcatattccgcttccaaatcctttaccatatccaacaagaattccttgtttccatcgaccatgtaacgtcccagtaccgcatccgcattccacgagctgaacttggtcattttggccatcgggcctccttcgttaccccgataccaagtatggataatctgattcaagtattccgggttacgcaaccagcggctctcataaatatgatgaccgatggcacaagctatcagattgtatttatcggcatacgaacggtttaccaagaattcggtcataccatagcccaccggagtttccttgatgtgcttgcgcagcgtccaccaacgataataatacatttcctcgaagttcttttgagagcactcgaaaagaggtatgttttcttccatccattgagatgcgcgggcattgggaacagcctgggctatattctcatcctccatactgttgaaataatccacgtagggcttgaaatccttatatttcaagaaagccgcaccggcatccttatcagcagaagtcgtcttgaaattggctatacgataggtgcacaaaggttcttgctcacctgcattcggcagaatgccataccagtctgccggagtatccaccgtaggataagtccgttgcgctccggtgcggaacatcactctttcaatggccggaacgggagcaaagaacatacgttgtcctgctttctttccatccacgtaaacggttaccatacggttagcaacagagagttccacttctaccttatacgtcttgcccggttcatacttcaacaaattaccaaaccgcgcacctcctttggcacggaaaagtccgtcggaagtcaattccagacgggaacaagcaataccgttttcatctaggaattctatttgcaaaaggcccttatcgttctgctccgccatcagttcgaaagaaactttaagttcttttgtagcaggtatcttacgctccacacgggcataatcgaacaaatccttatcttgcagcaccaaccattttccatccaatgatacgggagcccactgcaaagaatacaaattccagtcggtcagttcattcaaatctttatagttggcaaaattatcgtcagcatgtgcactggcatgtgcgcggacgggcacaggaatatgagagacccacatgtcctccttgttcacactgtaagtcacccacaaatcaccatcgggaggagttccgttaccttcctgaataccccgtacatactgaggcccgaatgatttataattacctccgtaacgcatcggtgtaatttcgccatgcaccaaattcaaggtcgtatattccagcccgtccttactgagcgagatagccagcggccaacggaactcggaaggattatacaccgtggcgtatgtaccgtcactcaaacgctgcccccaaatcttcgcattactgttaacaaaccctttcgcacgttccaccggttgcgcccacgtattcccaccatcctcgctgatggaagtcagggcatgtttccacaagcttaccaaacgaccgtcgggcaaagtatagtcacaatacgctttgtattctttgtgtaaaggaatcaacgggtcattacggtcagcttcctccacccactgcatacggtaacgaggattgtccagaatctcctgacaggcttttacaaattccttgtctttgctgcgtttaaaataaggataggatgtattcttttcattaaacgcatggttatagtaaatgaaataaatgggaccgaacgaaccgtctttcttaatctcgcgaaccacacggcctattccgttcccgtcattcgggtcatctttcttgtccagagctacgccatagtttcccatagctatcaatctgccgctttttgatacatagaagcctacacgctgatgcatgatggcatccagatctttcgccttgtctgtgcgtccgggcttggtatagccatcgggaacccggtagatagggaaaagagtcaccggatttgtccagtggtatccatcttttgaagtcatcaggaaagtctgtgagggaggaatatgctcgtctgatggatcggaaagataatgcatatagaattgtccgttccaataagccaacatggactgatgattgtatgtccatccattgccgttatcgggtgcaggatgttcccggttggcgcgcatcacctgaatattgtgtactcctaccacaggtgataattgtccgtcatgataggtagggttagacagctctgtgcctgtatagtgtactctatcttgagccgacaccgaaagtgccagcgaacaggctgctgcaaaggtaaaaagttgtttcagttccatttatttacttctatgttgtttttccatctattaaaatgaggtttctcttcagcttgattggcctgcaaacaagcaaagctctacaaaattacgaatttcttcgtttcccgataaaagctccgggctttaaaaaaagacgaaagcacaaagcaaatgtactctataaaataatgctatttataaaaaacgtctttttgttaaggaatttgcataaaagaagcttttttactatcttagcagcatgaagttaacagtttgataacttttctacgagaaatatgttatttatagtattcacttttttaacaaccgtttgcttatgaaacaaaagaataagatgttatccacccatggcattaaaacactattcgaaacccgattaacccaactcacttcattggcttcagaaagccaggatgaaatagctttcaaaaacaagctgaacgattatctattatccggtcctatttacaatcctgctgccgcaaggcaaattaaaagactgatagataacgatggaaaaaccatttacgaagcctctacagaacaggagattaaaatagaaaccatctcactgctttggaagtttttaacgaatagtatcatcaatgaagagatttccgttgatttatggattgacctgtatcaccagtttgaccggctttatcacgaagaggaggaactacctgatgaaaaacaagtgcaacaatggatgaaacgctggcccagcggactgaatgaggatgtccgggctatccgccgacaaaacaaagagcgtattatctcccttcttatccagaaaatagaaaacagacacgcgccttccagccgctatctttttcccgaaggaagcacggaagaggacaaacgccagctggtctgccaatggtggaacgaagcccgttttcatctggcaatggccataaaaagccctaccgaactgaaccgaatgctaggcaactccctatccgaagagaccttgcagctttatcacaaagcacgcaagaaaggaatgcctgtctttatcaccccttactatctgtctttgttgaatcctacggggaaaggatatgatgatacagccatacgaagctatattctgtactctccccaactggtggaaacatacggtaacatccacgcatgggaaaaagaagatgctgtggaggacggaaagcctaacgctgcaggatggctgctgccggacggacacaacattcaccgccgttatcccgatgtggccattcttatccccgactcgatgggacgtgcatgcggcggcctgtgtgcatcctgccagcgcatgtacgacttccaaagtgaacgtctgaacttcaacttcgaggaattgaaaccgaaagagagctgggacaagaggttgagaaaactgatggaatatttcgagaacgacactcagctcagggatatcctgattacgggaggcgatgcattgatgagccagaacaagaccttgcgcaatatattggaagccgtctacaaaatggctgtccgcaaacgaaacgcaaacctgcaccgcgccgaaggagagaaatatgcggaactgcaacgagtacgcctgggcagccggctcccggtatatctgcccatgcgaatcaatgacgaactattggatatcttacgtgagttcaaagaaaaggcatctgccgtaggggtcagacaatttctgattcaaacgcatttccagactccactggaagtaacacccgaagcgcgtgaagctatccgcaagatactggcagccgggtggactatcaccaaccagctagtatataatgtggcggcttcccgtcgcggacataccgccaagctgcgcaaagtattgaacggattgggtgtattgtgttactacactttctcggtaaaaggttttgaagagaactatgcggtattcacaccgaacagccgttccttacaggagaaagaagaggaaaaaagatggggaaaactttccgcagagcaagaaaaggagtttttgaacctgttgagaaacagtaaagaccgtgcggcagccgtacagcgtttctgcaccttccatcagattcctttcgtagcaacagaccgcagcgtactgaacctgccgggtataggcaagagcatgactttcgtaactatcggtatgacaaaagagggaaaacggatactggaatttgaccatgacccaacccgccagcatactccgattattcatcagatggaaaaaatatacatcaaggaaaacaagtctatctggcaatatatgctgcaattgcaggaaatgggcgagaagaaagaagaatatgccagtctgtggaaatatatggaaggagaaacagaacaccgcttccccttatataattatcccgatccgggattccggattacagaaaagtatagtcacttgtcagtagttggtaataaatcaatctgttaatttgtcaatgtgacaatgtgctaatgtgccatgcggaacaaagcgtaccccattgacatattagcacattgacaaatcagcagattattcaattcgtaatcttgatccccacaaaatacgttctaggctgtgtaggcccatagaaataacccgagtcacgataaccacctttgtccaaatccttttggaaagcattaaaaatattctgtactccaccgtttaactgcaatttgatatggtcattcaatacaaatgtgtaattcagtttcacattcaaatcaaagaaatcaggagtatgcaccatttcatctttagcgatatattgtcctatatattcctcgggcaactctgtcggtgcgaaatgcggcacatgcatccggcctgtgtacacaccggacaaggagcagtcgaaattcttgaacggagcagatgtcaatgtgaaataaccgtaatagtcaggagtacggggcatccgcttcaccggcgctacctcaggattctcactccatgcctccagctcggtatattcgctgcgctgcaccgtgaagcccacctgtaaagccgcatcacgtccatgtgcaatctttccgtccagattcacgccatacacacgtgccccgttaccgttgcgacgctccttcaccttgttaccgttctcgtcatggcccatatcctccagaacaaacacgtcatccaatccggtatagaacccttccaataacaaattggtctggaaatgaccgatattcgccgtccagtcaatggagccgctgatgctgttggaatgctccggtttcagcccttccgccaacttgataagcacgccctcacctcctactgcggtaacatgcaaatcctcatcgtatgcctgcggcgcacggaaaccggtagaccaggtaatacgtgcctgtagtttgtcactcggtttgtagagcaggttcagacgggggctgaagataggattgtcaatcaggttatggtcatccagacggaacccggccaggaatacaaactgattcattttccattcgttctgcacaaaagcgctggcaatacgcacatcctgtttcatatcacggtgataaccggtcataacatcgtgcagggagttgttctgatactccaacccggcggtaaaagtagcaggagagaataaaactttctcaaaattacccacatacatgccacctgccacccaagtcaggtctttcgtctttccgtatgcattcgcatcctgttgcgcaccataataactgttacggtcggtatgctggatggaagaatagaaagaaagcttatgcttgtattctttccaaaacagatcataactcaatccgccactattgatgacatgcttggtctgttcggtgatatccgtttcgtgcggctgcaaatcaaatttattccctccgcgacggaactcattcgtggtatgatattccagactgatacggctgaactgcgtaggacggtaataggtacgcagcccgaacgtattcatgttcagctttcccaactccgagaaaccgtccccgtccgcatcatacggattacggttccgataagactgatacaaagcgatgccatatgtattgtcttttgacaccaaagaggcgttggctcccatatactgttcccacaccttgccgttcatattggacattgttgaagaaacttgaaatgaattgttgatggggtctttcgtgatgatattgatggttccgcccactgcattagcaccaaacaaggccgaccctcctccgcggacaacctctacacgctctatcatattcaccggaatctgctccaagccatatacaccggacagagcactgactaccggacggctattgataagaatttgcgaataaggtccttccagcccattgatacgtacttgagggaagccgcagttctggcagttgttctccacacgcagccccgactggtaattcaaggatttagccaaatcggtagagttcaccgattcgaacagcttggcattcatcacattgactaccaccggagccaccttgcgacttgtctcattgcgattggccgatacaaccacctcgtccgtcataatactttcatcactcatcaaaaaatgaacatctaccgtgaagtcgttactgacggtcactttcttttcctgtgtctcatagcccagtagctgaaccctcaatgtgtactttcctgccggaaccttcttgaaacggaactcaccgtcctcgttactcaccgtaccctgcccggtttccacaatcaatatggcagcatacggaaggctgttctccgtgcctttttccactacatgacctgaaatcacattgccttccttcacaggatttacatcttctgcatacgcattgatacccgcacccatcaccatgagcacgagtaacagaatatattgtttcatctattttttttctattactaaaatgtttcggtttattcaataaagaatgtgtgtagccctatggcaaaaacacattcccatctgttaaagggattgcccgaatgtattccatcaacagatatacctttgtttcagcaatgaaaaggaggagcgcgcaaatggatacattgcgcgcaaagcgctttcgcgcggaaagtatttatcttatattccaaaacatacaacaaaggacggaatacagtcatctcggcctgaacctcggcctccaaagtatgaatagtgctcagatgagcaatagaaataacctgtcctgtggtatgcgtatggtgtttgccggacaaaggatgagagtgcacaatcatcaccccgttcacaatatgaacgtgggtaaacaaggtgatgcttacctgatacgttaaaaacagcgtcagcagtaataacggggctattatgtaccttctcttgctcaactattatttcttttcctcgccaaacagcaattgatagtctttttttgcggcaggcacagtccattcctccggaataaacttccactggtgcatggcatgaggatgcagcactttttcctgctcaatatattgcatcagataataacgcaaatccttatcggttgcaaaaataatacgttttgccaaatcttccttggaaattcctgctccaagggtcaataaatctccgccaccgttcccacggtaagaattcaaagccactttataaaccttatccatactgaagggagtcccgtccgacatgctttgaatcgtgattttctctcctgccggcttggtcacgtccaccgtataattaatacctgcggcagaatcaaagttaaagctgaaattcttgaaattagcacgctttccctcctctaccggctccttgaaaagcatcaggtggtcctcgggactcttcatctgattagtccagatggcgtatgccatttccaggaaatctttaatttccttgcccgagagttccatcacatacagcatgttctcgtacttgtacaaattaaacatatcactcacatagatgtctccttctttaatctctgctcggaaggacaacggagcacagaaggacacttcagcacccgaaatttccaattgcaactgatgaatcaggtctatgaaaggagaagaaccgaaataagcatccttcgctgtgatggtacgtgaaatagtaccgattttacgggatacgaagtcatttacagccttatattgaggagcgaatttatccataaactcctggctgacaggatacttgttcatatccgccaatctgccctccaccgacttcgccaccactttcccgtctttctttgttacggtcagggtcacatccgaaaccacattggcattgtttgccggatcaatgaccaacacactgtctcctgccacattctgcacctttacacattcccttgtatggtcgtgccccatcagcaccacatcaaagcccgggacccgtttggcaacatccatagaggcatcttccaccacctgtcccaacacgttgcccgactttccagcatgaaacaatcccacaatgacatcggggttctctttttcctttataatcttcacccacttacgtgcgcagggctccatttcctcaaaatgcaggccactccataacttctccggcaaccatgaaggaatggccggagtaatcatacccagaaccgctatcctcactccgtcacgctccaacacctcgtagggtttcagataaggttttccggtggcattgtctataatgttagcccccagtaccggaaaatcgcactgttttatccaacggtcgtacaccgcatgcccggtctctacgtcatgattacccatattgcctaccacacatcccatataattcatcatatccgccgccacatgggtagacacggtatccataaaattataatagtaagctgtaggctgaccttgcaggatatccccattatccatcaacaggcaattatccccatatttctcacgctgctctttcacaaaggaatgaacacgggcaagacttccactccattctttccgttcgataaagttatacggaaagaaattcccgtgcacatcactggtttctataatcttgataaccacttctttctgattattggatgcagacacctgcatacccgcccacaacagcagggcgctgatacatattctatatttcatatctctattctttttcttttttagttaaaggatgcgtgaatacaaaccgggcgccttcggtataatccttgtccacccatatcttacctcccaaattctcgactatcagcctgctgatggccaatcccagccctgtaccttgggaatattcattcaatttctcgaaacgttcaaaaaccctgtcgctcttatcggacggaataccgcaaccggtatccgacacagacaattccaactgttgatgctgtttgtctatggcaatcgccaatttaatagaaccggacggggtaaatttagcggcattggacaacaaattaatcaatacttgcttcaggcgctgggcatccgtcttgataaccagcgaagctacaggagtttcgaacagaaacaaagcgctggtcttgcgtccatactccgctgtagacaaagccgtctgacacaactctactacatcacattcctcccatacgaattttatttttccggattccatgcgcgagatgtccagaatatcatttatgaggtgcaacaacaaatcggaattcttctgaatgatatcacaatactgcgccttctcggcaggagaggaatcatcactgaccaacacgctggaaaatcccacaatagcattcaacggagtgcgtatctcgtggctcatattggccagaaaagctgtcttcagcctgttggattcttccgctttctccttggctaccaacaactcctcgccagacacttccagatgatgtttcaagtggttgatacggataatataatatatggctatcaagaaacagactatcaggaacatgaacgccgaaacaacccctatgacccaatatttatactgctcataaagcgaaggagtcttgttcaccaacaccgctccctgaggaagattcaatgaatccaatttgaattcatgcaaacgctttatatcaaaagtatagtttccgggaatagtcaccaagtccaccccttctctatctcctttatccaaaaaatcataagtaaccgcgcctatattctttcctaccgcatggtattcgggagtatatcctcccaatgcccaatgtcccaatcccacagatgcgatagtaaacacaggcagggtaggattcgcatcacgcagcatataagtcgtattaccaataacataactctccgtacagtccacacgccatgttcccaacaatacacacgtattttgaggcaatctgcgcatcctttcactcacttccataaaggtttccgtacgaccgtccagccaaatcgtctctaaatcagggtacttctccatctcctttttaaccaaggcttgcatagacagcccgccataggtattatccgatataaatgccacacggcgcatatcaggataaaagcgacgcatcaactctatgtttttatcgacatcatattcatatacataaccggcaacaatattataatcgccgaaatccgtataaatattcttactttcaggttcccatacccgtgtgtcgatactatcatcaggcaataccagtccgttgacactgaccataccacagatggacggagtctttttagctatctccgtgtcttgtgaaatataagccgaccatgcctcctgccccagcaatataaccagtgacggacggtttttccctttatacttaccaaggatggaggccatacgcgatttccacagataagcctcggacaaattcttgcagttcatactctctatgatcggagtatacttgccgccacgctgtcggtattcatccataaaagcagacaggttgtcagaaatactacgagtttcggggttataagaagtgacaataaggataggcccttccggggttgtttccgccttcacaggacacagagcaaccacaggaagcagcaggactaatagcataaaaaacctgaatatgattgccaatcccctcatttcctttagaataatttctaaaaattcgctgcaaagataataaaataaaaacagaacacaaccaattggcatgtattttgtttcccttaaagcagatgaaatttaacaaatatataatatggcttacatagactattacaaagtattgggagtggacaaaagcgccacccaagatgatatcaagaaggctttccgtaagctggcccgcaaataccatcctgacctgaatccgaatgaccctggggccaaagataagtttcaggagataaatgaagccaacgaagtactgagtgacccggaaaaacgtaagaaatacgacgaatacggtgaacactggaaacatgccgacgaatttgaaaaacaaaagcaacaatatggaggagccggtggattcggaggatttggcggagccggaagcggattcggtacggacggtaacggcagttactggtattccggcaatggaggagaagaattcagcggtgcacatttcggtggcagcacaagtggcttctctgatttctttgaagaactgttcggacatcgtggcggtgcaaacggcagacgaagtgccggattccgtggacaggactataatgctgaattacaactttcattgcgtgaagccgccgaaacacacaaacaagtgcttaatgtaaacggaaagaacatacgtatcactgttccggcaggtatagccaacggacagactatcaaattgcgtggtcatggtgcaccgggagtaaacggtggtcctgcaggcgatctgtacatcacctttgtcattccagacgatcctgtattcaaacgtctggggaatgatttatatatcgatgctccgcttagcctctacaccgccgtactgggtggtgaagaaaccgtggacacactgaacggcaaggtaaaactgaaagtaaaacctgaaacccagaacggaaccaaagtccgtttgaaaggcaaaggctttcctgtttacaaggaagaaggcaaatttggcgatctgatagtaacttataatgtcaccattcctagcaaccttaccgaacatcagaaagagttgttccgccaattaaaagatagtagcaattaaaaaaagagaaggattatgcagagcgatttaattattatcaacgatttttgcgaccgttgccacgtggacccgtcgttcattacggaactggaagaagacggactgatcgaagtccgggtgattgacgaggaacgctacctccccgcatcccaactagcggagctggagcgttacacgcatttatattatgacttgtccatcaatattgcaggaatcgacgccatccaccacatgctggaacgtatagaacttttgcaacaggaagtgcgttcattgagaaacgaattgggattctaccgctaaattccgtgtccggagagggaaagtgaaaacagcacccacttctctttccggcacagttcatttattttaaatattcttcctgtttttaccgttgtttctatacaataagcaggagtgccgaaccgagcatcactgattttctcctctttattatatataccaagaaaaagtaatgggctgttccgctctttctttgttttttcatttattttcttacttttttccgctttattatcctacgtttaacctaaaatcgctatctttgtaaacttaaaagcagccggccggtctgccgctgacgccgcaaggcgaaagaggaaagtccgggcaacgcagagcatcctacttcctaacagaaagccatctgcgaaggtggagtaacgtagaagaaaacaaccgccacaattcctacgggaaacggggtaagggtgagaaggtggggtaagagcccaccagccgcatggtgacatgacgggctgtacgtcttaggagttgtaaggtcatgtaaaccgacattatgagggttgctcgccccacgtcggagggtagaccgctagagcctgttggtgacaacaggcgtagataaatggcaggcacttcgccgcaaggcgaggaacagaacccggcttacaggccggctgctttttttcatatatcctaataaagagcttatgagtaccatgaacaaggaaaaactgaaaggtctgcaatcgtttctcaaagatgatatatggcgagtgacagaagacgaggttagcaaatcccgaggaatactctataatgcaataaaaatcgccactctttctattcgtgagttcactcagggacgtattttgaataaagcatccgcactgacatacagcaccctgctttctatcattcccattctggccattctattcgccatcgcacgtggatttggtttctccaacctgctggaaacccagttccgtagcggtcttgaaggacagagtgcggctgccgaaaccattctcggcctgattgactcttatctggtgcacgccaaaagcggggtttttatcggagtgggtctggtaatgttgttctggaccattttgagcctaacctataacatagaacgtaccttcaattatatatggcaagtgaagaaaccccgtacgctgtatcgcaaaatgacggattatttctccatcctgctcttgttacccctacttatcgtactttccagtggtcttaccatctttatgtccaccatggtgaaaaacatggaggacttcgtattactggcacccctgatgaaatttctggtacgcctggttcctttcatcctgacttgggccatgttcacggggctgttcgtctttatgcccaatactaaagtgaaactgaaatatgccatcattccgggtatcatcgcaggcactgcctttcaggcttttcaatacttgtatatcggcagtcagatatgggtatcaagatacaatgcaatctatggtagtttcgccgctattccaatgttcttgttatgggcgcaaatttcatggggaatctgcctgtatggcgcagagctttgctatgtggcacagaatcttcgcaactacagtttcagcaaagagacggcaaatatcagccgccgttatcacgactttctgtgcatcctcatcatgtctctgatatgcaaacgatttgaaacggaagagactccttataccgccgagacactcagcgacgaacataaaatcccgataagactcactaagaaaatcctatacgaactacaagacatgcacatggtttacgaaacttctatggacggtgacgatgaaagcataggctatttgccgtcagtagatatcaaccggatgaacgtggctatgctgctgaacagactggacatagccggaacagaagccttcaaaatagaccgggaacgatatagcggtccttgggaggcattgaccaatgcccgcgaagaatattataaaagcaccagtaagatattgctaaaagatttataactctgatatttgttttaccacagattgcacagattctttttttgttcaaaagccgatgcagataattccggatttccacaaagaacctttttttcatctttaacaatcatctgtgcaacctgcggtgaaagaatcaggagaactgcatcatgcggcttaaatatttgccgatgatatcaaactctatattcacaatgcttcccactttaaaagtatggaaattggtatgttcgtaagtataaggaataatggcaacctggaaagtatcctccgtagggttacaaacggtcagactcacaccgttcaccgtaaccgagcctttgtccaccgtgatgtaaccgcgcttcgccatttccttgtcaaacgcatatctgaaagtaaaataccagctcccttcagcatcctttatatccatacattcggcagtctgatccacatgcccttgcacaatatgaccgtccagccgcccgttcatcatcatgctgcgttccacattcactttatctcccactttcaacaagccgatgttggaacgctctatcgtttctttcatggcggtaaccgtgtacgtgccatcctgcaaactgacaacagtcaggcacacgccgttatgagagatactctggtctattttcagttcgtccacaaacgaacatttcaaggtgaggtgcagattttcctgctcctttacaatacgcaccacctccgcatattcttctacaatccctgagaacataagttttagtctttaattaagtttcgagaacaaagatagaacaaaaaacacaaatattcgaaacttaccgactattaatgataaatgaccggcaattcgtcactaacttaccttttttacatattcagaacaaaaatagactgtccaattcttttttattatatatttgcactttatactttgcaaacttattaaaaacaaaccatggacagcacaaagattgttggtgaaaaaataaaatcactacgtgaaacaaaagaaatcagtgtagccgaactggccgtacgctcaggccttgccgaagaacaaatagaacgaatagagaataatgtagatcttccttcattggctcccctcatcaagatagcccgtgcgttaggggtacgtctgggcacttttctggacgaccaggaagaacaaggagcagtaatctgccggaaacaagagagtgaggataccatcagtttctcgaacaatgcaatggacctgcgtacacatatgcgctaccactcactgtcaaaatcaaaagcggacaggcatatggaaccattcatcgtggacgtagaaccgacagaggaaacccacttctcgctctcctcgcatgaaggcgaagagtttatctatgtcatggaaggcaccatcgaagtatgccacggtaaaaaatgccatctgatcaaagccggagacagtatttattatgattctattgttccgcaccacgtacacggatatcaaggacaagccgccaaaatattggccgttatctatacccctatttgatttatgatggaattaagcacaagaacccttggtgactggcttgaacattgggccctcaccacccccaataaagaatatatcgtatattccgaccgtaatctgcgcttcacctggaaacaatttaacgaacgtgtagaccacatggccaaaggactgctagccatcggcgtgaagcggggaacccatgtaggaatctgggcgggtaatgtgcccgactggctgacctttctgtacgcttgcgccaaaatcggtgccgtggccgtaacagtaaataccaactacaaacaggcagaactggaatacctctgccagaactcggacatgcacacgctgtgtatcgtaaacggagaccgtggcaatgacgactatgtaaatatggtctacgccatgctgcccgaactaaagaccagccagcgcggatatctgaagagcaaacgcttcccctgcatgaagaacgtgatttacatcggccccgagaaataccggggtatgtacaacaccgccgagattctgcttctgggatgcaacatagacgatgacgagctgctggaagcgaaagcgaaggtggactgccacgacacagtgaacatgcagtacacttcgggcacgaccggtttccccaaaggagtcatgctcacccattacaacatcagcaataacggtttcctgacgggcgagcacatgaaattcacttccgatgacaaactatgtgtctgcgtacccctgttccattgcttcggagtggtgttagccaccatgaactgccttacacacgggtgtacgcaggtaatggtggaacgctttgacccactgctggtacttgcctccgtccacaaggaacgctgcacggccttatacggggttcctaccatgttcattgccgagctgaaccatcccatgtttgatatgttcgatatgtccagtctgcgtaccggcattatggcaggctcactctgtccggtagaactgatgaaacgtgtagaagagaaaatgtttatgaaggtcaccagtgtatacgggcttacagaagcttctcccggcatgacagcctcccgcatcgacgattcgtttgatgtacgctgcaacacagtgggccgtgatttcgagtttacggaagtaaaagtgatcgatccggaaacaggcgaagaatgtcccataggcgtacaaggcgagatgtgcaacaaagggtataacaccatgaaggggtattacaaaaaccccgaagcaaccgccgaagtgatagaccggaacggctttctccactcaggggatttgggagtgaaagacgaagaaggtaattatcgtatcacaggaagaataaaagacatgattatccgtggcggagagaatatctatccacgggaaatagaagagttcctgtatcagatggaaggaataaaagatgtacaggtagccggtatcccctccaagaaatacggagaagcggtaggcgcattcatcatcttgcacgaaggggtggaaatgaacgaattcgatgtacgtgacttttgcgatggcaagatagcccgttacaaaattcctaaatatatcttctttgttgatgagttccctatgacgggcagcggaaagatacagaaattcaagttaaaggatgtgggattggagttatgccggaagcaaggcatcgagattatttaattcagccttctccttgcattaaagagcagaattaagttacacagtcacggagaggaatacattgcacggattcttctctgtggttctgtattgggtatcggaaccggacagcagatgtaagcctcacgttattccataaaaaaaggagcaacgccttgctccaaccttttgttaaccttaaatctaatactatgaaaaacacacatacaaatatacgcactttcctgctatctgcaaatttaaggaagcgttaaggagaaattatagtattgtttaataaaagcaacaaatcctttaacatttcaagttaatgcgaatggtttcttttaacaaaacaaaaaggctgtcccgtaaggaacaacctttctatattttttatagtagacgcttctacttcagatgcaactacttctctcaagccgattgcaatcttcaacctttaatctaatactatgaaaaacacatttatataacacggcggcaacaagaattgttcaaccgcaagtcattaataaatgtttaaatccctaactataccttttcttcctttggcaagaccgaatgccaaggaattccgtctacagtagaaaggtccttgccagactctatcaaaccactgattacataatctctggcagtaggattctggaacggatacaatccaaactcgggaagaacagaaacaaaatgctccatgatttccgcctggatagattcataactaggccagttcttattggccgagaaacaataaatttgtacaggcagaccattctccgtaggagccaacgtgcgtaccatcagcaacaggtccttactgataaaaggatggcgcttcagatagagagtcatataagcacgaagcagccctacattcgtatcaatggttccatttaccaatccggccggattgtcagtattcgctacctttccttcggccgcctgtttctgcttttctgtgataaagtcggccaaatcagcatcaaacttcttcattttctccaaaaattcaggagtacagggttgtatgtaatccagtttcaacgcatactcgcgcataatacgccgtccgcccgattcagtcatcccacgccaattgataaatgaaccggaaactaatgaataaggaggtatagtgacaatagtattatcgaaattctgaaccttcacaatgttcagagtgatatccatcaccaccccattcacattattctgaggcatctcaatccaatcgccgatatgcaccatatcattctcggaaagcagcacccccgccacaaagccaaggatggtatctttgaaaatcaacatcagcacggcagcaaaagcacccagtccggtaatcagattgagaggcgacttattaatcaatatagaaatgatgacaatgatggcaatacacgaaaaaatcacttgaaagatttgtatgaaacctttcatcggacgattctgtaactgctccttgttcatcagcacattacccaccgaatttaacacggcattgaccgaaaacaacaaagcgataaagaaataaatccaagtgattttttcactggcagtaaaccaagtagaacgataatcgaacgcaaacggcaacaaagcggatataataagcggcggaatgaccgcagacattttccgcaaagcattgtattctatcagcgaacttaaaaaactgatatttttatatttcaacaccttccgtgtgaaacgcacagataaataatgaaatacagctcctacagcaaaagcaataactacaatcaggatcaagaaaataatctcatccagttcattcaacctatcgcgcgggatgcctatccatgatagaaaactcttaatccaagtcaataaaattcgggcaaattcatttgtattcataattatcgtcttttttacttatagaaccatctataaaaacatttgtttagctgagggatgaaaaatcctccccagtctgtccgaaaacagtttcctgctttccttttactctgtcattccagcgtaacaagactttctcaaggaatcggcgaagtgaaccaagaagtcaaacaaatctatttattgaatataccatctttcgcactggctgtagacggcaccccaacataacctcccaaattacaattagaaaccccaattgtcttcgtattcgaaaaactaagacctatccctgctttatccacatccatgttatcaaaagtcacattataaataggctttgcctctgtaccttgaagcaccaatgcagctacattcacctttttgcatttcaaatcctttacataaatatcatgcacctcagtaaaatgatggttatccatcccctcgcctgcatacatggaagttacataaaaaagatcctccacttcaccaaactcacaattattcacataaatatcacgaataaaacctccacggtccggattcgtcttgataaaaatacctcgtttacaatagcctccgtaagtgcaattctctacgaaaacatgctgtattcccgatgacatctcactgcccaacaccacaccatgaagccctttgaacttacagttacgaataataatattttccgaaggacaactggttttccatccgtcattatcccgtccgcatttaatggccacattgtcatctccattattaaattcaatattttcaatcagcaaattacgggtgtactcagggtcgatgccatcattgttgaccaattttgcatcataacgtatgccacggcagataatattctccgatttcagtaaatgaatacaccagaaaggcgcattcgtaataaacacatcctcaattgtaatattcttacaatcaaagaattgcaccagatgcggacgcaaccaatacccctcaccgaagttccgttcggctaccggcacttctttatgattcatttcacgactaagctgctgccctatcttctgcttacttttccaagtggcaaaagtagtccccgcatttccatctatcactcctttgccgatgatggaaacattttccaactgatatccataaataaaaggactgtaattctgaaggaaagttccttcccaactggttttcaccagagggagataaaaagccggttcagatgaaaatttcaaggtcgccccttcctgaagttccaaacatacattacttacaaaatgaataggaccattcaaaagatattcccctgcgggaaccacaatatgtgctcctcccatatgggcagcacgcttcatcgctttatcaaatgcaggtttacaatcttttttcccatctcctttcgcaccaaacgaaataagtgaaatctgctttttcggacgaacggctcctgtaatttgtgctaaaatagcatcacgtttggctgtacggagcacatcgtcaatagccaaacaaggatgaaaagcccatagtgcccatattatcaccaataggcttttgtacttttgtgttgtcatagtcggtagttgttttatttatgattttcagacaagcctgacaaagaaaatgttctttccttggggcatccggaccaaaagtacaaatatattctgatgtaaaagaggaaaatatgacgaatgagtgggattttttgttcagaaaagaagaaagttccgtttttaagggatagtagaaatttaacgggaactacttcttattttccggttcatacctttctttagattcagtatatacatcttctgcatgcaaaaagggttaacatgactttttaaccggttcaatctttccgctgccgtgaagcccaaaggaagaagaaactgagaaaaagtaacaacccgccagcggaattaaacaacaatgtattgcatccgtccctgttgcataagccttttctctttccaggttaaacctttttatacggattattctatctccatagcccttggagttatctccataagctttggagttatctccaaaggctatggagttaactccaaaggcttgcggagatagaacaagcaggaagaaaacccttaactatccaatgggaaaggtttagagatatggacaagatcttttccatagccctgcttttagatgaatcctttttaaatatttccataaaaaaagctgtacccccgaaagagatacagtttctttatgtgattccgttgcgattcgaacgcaagacccacgccttagaagggcgttgctctatccagctgagctacggaaccatccttaattgcgagtgcaaaggtacggtttttattgaaattaccaaaagaatccgtaacttttttgcattaacaacctatttttttctattcaacatccaagcgaaaggtaaatagcaacaaatatgaaaaacgtaagacactatatatgaatctattccaacccattccaccaaattcgtatacatcaatgaggaaaagaactgaactataaaaaaaagcaccacaaagtaatcggcaaaacgagaaaagagacaggacatccctcttattatatccttatcatcccgaaaacgtcccgatgcatagccgaaagccatacccgataatcccacaccaaacgaaatgagataataaatccctttttgaaacggagaattcgtgagagatcccgtcacgctacgcaacatagtccatggggcaaaagtggtgccaataatcattatgatataaacaagcagcatacaacctgccaatatcaacgcacgcttttccttacgggaaatgggctttcctcttttcactattctccccaacgtgccccataccccggaatgaaccgtaatgccgaaccctaaaaaaagcatcattactatgcccaatgccggtgtctggacaaaattccccatagcatgcctcaattcccaccggattccttcggggctgagcaggctttgcaccttccccagcccataaatacttcctatccatgagaacaaggctacagctactgtcagcagaaaaaatacagtagcggtatgagggaaataatatttactcttcatccggttccaaattatcaatatcaagaatccgcaactcgaaagcacgggtcaccaagcgacaggcattgacaccatttctttcatccaatgtgaacaaacggtttattaattcattctgacgtttctctatggacttgaccccgaaaggcatccctttcagattagtaatcatttctttggtataccccaaggccagatggcgaagcaaacgctcatcatattcatcaatatcataatcgatgacagcttcctgcctacgctgctcctgagccaccgactgcttgaaacgtgccactattttctccagaatgggataattgaaaaccagtctcttaccatccatcaccgcctgtacatctgtggcagtcagcaactctcccgtcttcaggattataccatccgcacccgcattcagcgcatccacccataacttttcgttcaacacctcaccagtgaaaatcagcaccttcatatccggatagttcttccgtaaagaagaacagatttccacaccgatggtagtcgatccccccaagcccaagtccaataaaaccatatcgggcaactgcactttcagcaattcccaaaactcattctcagtcatggccgttccgatgacttccgcatttggaatttcgtgtctgaatatctcttccgttccttttaattccagtttgacatcctctacaatgatgactttaaatctattattctccataatatgcattgtttttttacattctacattcaacgggcaggcagggtgaaccatacggtgaaccctccctcagcggcaggctgcgcattgatacggcaaccgcgtcttccggcaaattcatcatggtcacgaatcacctgcttacaaataaggtattccgtaccggtcagaactccttcctgcccctgcttcatacgagacagatgtgggtagaacaacaagttcaactcttcctgcgacttttcgcgacgcgtatcgcggaaatcaaaccgcacaaaatccttatcctcataaatacacaattccaaaaggccatccacctcgtatgatagcgcttcatctatcagattctccaacataaacttcagctgaatgacatctcccagtacggaaacatgttccacctccgtcctcagttctacccgatgcggcatacgttttccagcacgttttatataccgtgccgcataatcggccagctcgccggctttcacaacacctctgcggaaagtaatttcttccaactgacgtgcggcgcatgaactcagcaaagtaaatatatccttataataactgatcaactcaccaatcgtctctacttgcacagcttcgttttctcctgcctgacgggtgttcaacctgtcgataatctgttttatccggttaggataatagattgtctcatgcttaatggttgacaagcaattgtccaataccaaattttgcacatgcaactggttttcctcccgtatagctcggcgcgcatcatcctgcgcactttctatatcccgatatttctgtgccatcagtaccactgcattatatacaatgatggctacatatccggccacaagctccaacatcaagcggtcgtcctcacgctccacaggcaaagcgattttcaatgccagcacacccgtgcaacgattctcgttacctgcttccacccacaagggcaaacactttaacctatctttctcacgccaataagatgtcttcgcgtcaaagctacgggccatcatctcacgcatttcttcgttctcatcctccaccggtgaaaaagcataattcaagctatggttgtcttcactataaaccgctacgcccaacacatcaatgggcagcaactcattcaccgtctcaaacatatcattgaccagacttgcagcaatatcccggtcggttcttccgtcaagcaaagaggccgaaaacacctgcttgttgatttccaacacctgttccaagttataacgataaatcaaacggtggcggaaatacagaatataataacccaccagcaataccaacagaataaccacacaaagaatgatagccaccgtcttattattggcagaaagctgcatctgacggcaatattgctccaatgaggtgtcctcactgatttgtttgtacagcgccgtataagcattattgttataacgataagcctccagattacctaaagccaaaaaagcgactgctgcctcgttgcgaacatccagcaaggcatagtaatcggtatcaaaatgccggttgaaccaatctaaatccgctgcagccccctctccttccaattccaacaaaggccctttgctgcccgaatacataatataatgcttattcaaacaatgtagagcactgtccgcataacacaatgcctgttggtatagtccatcaatgttacaattgtaaacatcgtatgcatattcattcgcaacagccaataatttatcatatcgctgaatggaatcattaagagtgagttgttccgctttcccgtctttctctctcccctcattacatcctgtcaggacagaaagaaaagcgaccagtaccaacatcaacgttttgcgcactcctttgggcagacgaaaatagaaacggctgcctttccccaattcactttctatccggaacaggcagacccggaatatttcattggtcttcttatatttatcaataatgcctttgcaattcatcaaaccgaaaccatgacctttattcttctgcaattcgctgacattttcgctggtctgcaatccgattttacctgaatcataaactttctcactcagaatacgctccacatcttcctgtgaaagccccggaccgtcatctttcaccgaaatctccacgtaagattctgtttcctgcgcataaacagaaacatttcctcccggctgcgtatatttacgggcattttctgtcaacgtatttatcatgaaaagcgtcagagccttatccgctttcacaatggcggcagtcggctctatggtcaaggtctgttgtttcatctcgaaagtcttacgccctttcaccagtacatcgaaaagggaattcaattcaaaattctctatattcaagctcagtgtcccctgcctcatcttaatccataaggccagaatatcattatactcattaatacgggtaatcagttcgtcgatataacggtatttgctttcttttatttcttcgttctgaatatagttgtgtacggttagtttatgcacttcattcatgatgcggtctatataaggcataatgcctgtgacaataaacaaacaggctttcttcaccagattctgccgtttattctccgccaaatgctgttcatggacatattgctccttttccagccgtttccgttcatcgcccaacgaaataaaagccagtccattctccagtgtccacgaaatgtaaggtgtaatgaccctcatcagtgctttatcatctttcttcattttgtgctccgaatacagatgcacctcgcccaaaggttgttccctgcttggaatattcaagataaaacttgtacaaatcccttgtcccggcacctctcttccctctccattttcagccacaatacggaagtccgtggctcccaccaacggaagaatatcctctttcaccgaggcaactaccgcttttgtcacatcctctatctcccccgcatcaatgggtacggaagccgttatcttacggcatatttccaaagtacgtttcaacttatcaatgtaaagagcattccgcacacgccatcttttattcaatatccaaaatagaatgataaggacagcgataccaatcaccactaccaccagaagtccgttcaaggcttccgattccttctccaacgcattataacgactctccaattctttgtcctggcgggtgtagtccaaaatatccagataaatattacgattataatccgactggggtttcattcctaacgccgcatatgttacactcaattgttcacggaaacgggcgatccattcggggacactttttataccatcgtcattaatccattccagttcaatggaagtggtagccatgggaacatacggacgaagcctgtccatggtatccgtacaatggtaatatttttcgtgatgccggttgacgtaccccagcgcttccgacaagtaatgcagcgcgtcttcatacctgccttgctcgttgctgcacgacgccaaagtgcggtatgtacccgaaatctgatacaaatctccatattttttgaacaaatccaaagcctgccaggcaaaacgcatggtcagttcctcccacggcaagtcctcgctattgatggcacgcatcacattgggacgcctttccataattaaatcgaaatttttcctctctttcagcaattctgccattgcctgagatgcattcgcctcgaaatagatatacccgtgttccctactgatacccagacattctatcagatagttaaactcacccaataccacatcctgcggtgtatccgcttcatacataccgccagaccctttcatataataataatagagcaactgggcagtatcactttccagcgcctcgtctacttttatttcattaatcgcctccaaggactgctgttcctgctgcaaataatagtaataaatggcagaagcaatggaaaactcagaacgggcataattcagccgttccagctctccgggatcagttatagcagaacggtcatcgctgatacgtttcatacgccgtaacgcactgttacgataatcatagaactccttgttcatggcggtacgctgacaaattttcatcataccgatatctgctatcagacattccaattcattgtttgactcctcatatacgcgaagaaaaagatcttcggctttttcaaagtccatgtggataaaggcgcagaaaccctgattattcaatgccccggcacgcagggaggggaatccatccgccagtttgtaggcgtcatgcgctgctttacacgctgtgtccaaattcttatagcgcatatgataagaaagcaagttcaaagaatccgcctgacggtatatagccatatccttcttcttttcacaagaaaagaaagtccctgctataatcaataaaaccgcccatacaggcaatagacacatattcttcataaacatcccttctcctttaggttaaccacccaccaataaaaatacaaaaatatcaattatcccccgaaataaaagcaaaacttagtagaaaataagaaagccaccccgaaggatggcttataaaaatctttaaaagacgaataaaagattacttagaagcttccaaagatgcttttctaaattctttcatcagtttttccaattccaatgatgctttacgcgcacgtgttcctgcagctttgttacctttttcaatctgcaatgcagcatcagacataaaagcttcgttcaattctttgattttagcaattaattcgttcatgttctttttttttataaattataaaactgttcaaattaaattcttttttggcaataaatctcctatctatctctttttttacgatttttcaacagtttatccctggttgcagcatatttcagcagatttggaagtatcttaaatgctaaattagtgctataattcccaatttacggactatttttattcctaatacccaaaaacatcgtatctttattccctataatcaaggaggtttaaatggatttacgtacagttaatgtcactcgctacattatgcccctgcgtgagggaggttccttgcccgcattggccgaagcggatgatgattttaaatatgtcgtcaaatttaggggagcaggccacggacccaaggcgcttatcgctgaactgataggtggagaaatagcccgtgcccttcatttccgcgtacccgaaatcgtctttctgcaactggacgaagcatttggccggacagaagcagatgaagagatacaagacttgttgcaatggagccgtgggctgaatctaggacttcatttcttgtcgggcgcactgacttttgaccccatcgtacatcaggtagacgtacaaaccgcttcacaagtagtatggctggacgctctgctcaccaacgtagaccgtaccatcaagaataccaatatgctgatgtggcataaagaactgtggctgatagatcacggcgcagcactttactttcatcattcatgggaaaactggcagaaacaggctgtcaatccttttctaagaataaaagaccatgtacttctgccttatgccagccagttggaagaagcggataaccggttcaaacaaatactgaccgaagaaaaactacaggaaataacagatgccatacccgatgactggcttacttgggcagaagaaggagaaacaatacaagatctgagagaggtatattttcattttttaaaagaaagggttcaccattccgaactatttgtaaaagaagcacaaaatgccagaaaagcacttatatgaatatgcagtaatccgctttgtccccaaagtagagcgtgaggagtttcttaatataggaatagtcttgttctccaaacaagccagatacctgaatgcaatctatgtactgaatgaacagaagttgcgagtattttctacggaagtagatatggaatgcctaaagaatgcactacaggtatttgataaggtatgccaaggaaagaaagagggaggaagcatagcacaaatggaaattccggaccggttccgttggctgaccgctgtacgtagtgcctgtatacagacttcacggcctcatcccggattttccatgaacctggatgctaccttacaacagttgttcaaggaattggtactataagctatcgtccggcgcaccctatgtaccggaaaagattagctgaaaatataaacaatcactccggttattaccacatacgccagtgcatatggaatggcggattttaggatttccccttcttttccctgttggtttccggcagaagtggcaatagcgatgctttgcggagaaattatttttccacctgtcgcccccaccgtattggctgccgacaaccagtcgggacttacttgaatatgcccggccacattagcctgtaatttgccgaacaaaatatttgaagaagtatcactgcccgtaataaaggtacccaggcaaccaataacaggggcaaacaacggataaaggcttcctgtagcaaccgccaaagcagtggctataactgaaatcatacctgccgtatccatgatagtggacaaactcaccagacaaattaccgtgataaaagttttctttaactgctttaccgtattccagagtacagcaaacagctcccatatcttggctccttgtatcagcccaccgacaaacgtgcccacaaaaagtaaaactcccgcatgggtcagccaagaaaccgtataattcatagttgaatcattaatcggaagactgatacgggtcacccaattattttcaagtgttgtacgcaaaccgggaaacaacggactagtcagaataatcaagaacaagataagaagatagatactccacgcgttcagtacctcgagccctttcaatgtgcttttccttgctttttcctctttagaagcagtcagtttgccataggccacaataacaatgatagataaaatacttccaataatagccggagactccgcccccatatagcgggcggcaatatactggctgcctaatgagacaccaccgaccaacaaagacaggaaaatatttttaggtaaggattttaatttcgaatcggtcaggaacagcaatacgaaaggaatgagaaacatcagtaccgaaagctgcaacacgacattggcgcttagcaccaatacatccagattcgtttctttcgccaataccaagaccggtgtaccaatagccccaaaagcagtagccacactattggcaatcaaactgactgttgccgaaaataccggtttgaatccgaggctgataagaatcgccgccggtatagccactgccgtaccaaatcctgccatagcttcaagcaagccaccaaatccccatgtcaacagcaatacctgaatacttttatcggtagaaatagaagaaaactgttgcttgataatctccattttttcagtcttcaataaaacattatagctgaatatcgccatcaaaataataatcagaataggagaaacagctttcaatgcaccgtacagaaaagaaaacagcaaatcgtctaccggaaaatgaaagccgaaaaaagcaatcagcatagtaacgacaagggaaatcacactacttttgtcaccggacattttaaaaaacgccatcaggataattaatagcaataccggaataatagcaaggactagattcataaccattgtatttaagttaaagaaacggtatccataaactcttaaattaagcctttgaaaccccacttccgcaaagattctttttttaataacaaaaaagaatcctatttggattaatgatctatccttttttattagtaaaaataaagtaatgccagaagcatgtataatgtatctttacacaaacctccggcatacacttcttatccatatattgattttatattgtagtaatattccttattctatatagtatatcttattaaattccagctaatgcctgatccaaatcggccagcaaatcatctatatgttccgtacctattgataaacgcactgtccccggataaataccctgttccgccaattcttccgcattcaactgagagtgagtggtactggcaggatggataaccaatgacttcacatcagcgacattggccaacaaagaaaaaatttccagactatcgataaaacgatgtgcttcttcctgaccacctttcacctcgatagtgaaaatagaactggctccattggggaaataacgctgatacagagcatggtcaggatgttccggcaaggaaggatgatttactttcttgatcttcggatgatttttcaaatgctccaccactttcaacgcattctctacatgacgttccacacgcaatgaaagtgtctccaatccctgcaacagaataaaagcattaaacggactgatagtcgcgccagtatcacgcaataaaatagcacgaatacggacagcataagcggccggacctgccgcctctacaaaacgcaccccatgatagcaaggatctggttctgtcagttgaggaaatttacctgatgccacccagtcaaatttacctgaatcaacaatcacgccacccagtgaagttccatgaccaccaataaattttgtagcggaatgtaccacaatatccgctccatgctcaatgggacgaattagataaggagtaccaaaagtgttatcaataatcaaaggtatgtgatggcgatgtgctatttccgccacagcctctatatctataatattcgaattaggattccctaaagtctcgataaacaccgcctttgtattctcttgaatagctttctcaaaattagaaagatcactagggtccacaaatgtagcagtcacaccataagtcggcaacgtatgagccagcaggttataagtacctccgtaaatagtctttgcagctacaacatgatcacctgcacgagtaatgttctgaaacgcataagtaatggcagcagccccggaagctacggcaagtcctgccactcctccttccaatgcagccacacgctgttcaaaaacagcttgagtagaattagtcagacgcccataaatattacccggatcttgtaaaccaaaacgtgcggctgcatgtgccgagttatgaaatacataagatgtagtctgataaataggaactgcacgagcatccgtagccgagtctggttgttcctgtcctacgtgaagttgtaatgtttcgaaatgtaatttttttgtagccataatctttatctttttagagttatatatttctgtttttacctgttgcaaaggtattaaaggtagttatatcaaacaagatatactaaaaataaagaaaatagagctacaatcatcactatttacagaacaaatattctatttacaaacggattattacctcctggaagaaaattattctttggcgacatccaacaaaataaagtgacggccgattcacatcgaccgccatcagacaattaatacacacaatacgattgatacaaaagatcactcatggtcatgatcatgttccgtttcagtacctccgtccgcactcaagacaatattacgagccacttctgtctgattgcccgccgcatcggtacaccataccatcagatgataatctccgggagcagcatcagccggaataacaatatcatgatgatgtacttttgtattcttcaaaccggaaacatcatataccttgtcaaaagtaaaagctatgtttttctgtccggctgcccgggaatcatgtccgtggtggtcaaaattattatgaatattgattttatacgatttcaacatcacatcatctgacaaattcatttcaaaatgtacccctttctcattaccaattttcaacaccgctccctcttcgggttctatcaaatcgatcacgggctttgttacatcccctttttcatcattatcacacgcaggcagacaaacagagcatatagccaataggctgattacaagaaaataaaattttgttttcattttaataattgtttaaatggtactttaatcgaaatctgaaagtttcttcccggttcagggatttccactttcctataaaaactcaaatgattgtaatatttcacatccgacaaattacgaatacccaaagatatttcaatatccgccttggccataggtatatgaatactcccacccagatgaatcaaacaagctccggatgtgcggtcttcatttctcgctatacggttctgtgaagctatactttgaaattcagcatacaactgaaaatcctttttattccatgttagaatgttccgcatggatacaggaggtgaaaaacttaaagccgtatgttcgtcacgattataagtatagacatactcaccaaccaaacgataattaaaatgacgtagaaaatccatattgaaatttatctcaccacccatgaacaaagcacgtgcgccactatattgataaatctgtccggcatggggcaatacagaccattctcccgtaggacgcaaataaatataattatcaaaccaaccggcaaaagatgaaacaaccagttccatttttttataagccaaggtataggaagcatcaatctgccatccttgttccgaagaaagagtggcatctcctttttcatgacggaaagttccgtgatgtactccgttggatgctaattcattgccccccggcaaacggaagctacgtcccacattcatcttcagaagatgaccggcagcgggtgtccacactactcccgccgaacaggagtaattaccataagccctgtccaccggataacttcgccaacgatatgcctgtattacctcttcttcatatccttgtctgtgtagatactccaccaaataaggatcttcgaatgctgttatatcaatccttccccgatcataacgtatcccaccagttacagacaactgattatccagtcggaaagtcgtcagccaaaaagctccggtaataaaacgcttgtattccggtagcagaaaagaatatccgccaatcgcatttttctgtatctgcatattccaccctgccatatgctcccaggaagaggaattgaacaaccgcagcttcagagaggagctgaatgtatgcagtttgaacaccagttccctatccggatcctttgcaggcatcacctgagtgtcatagtgggtatggaaagcactccattcctcccgatgattgaactgatagccgaaatcacctgaaagttgtaccccattccaaagatactgttgatgcgtggttactttaagatggttcactttgctataaggcaagtcaatattacggctgttcccatcatcctccaaacgggaaatatcaggaatgccatgagcaccaggaaagaagcccatcttctgataaacattgctcacagcaatattcatctgataaaacttctttctataatctcccatggcagaaacattgcgctcgaacccagcggtgtttttcagcttatgaccgtaaacaggcaccaactgggtaagatatacaatggtatctgccggtacatgataatctccatagtgctgttctgagaaacgtactctgaccagccatgcattcttctcaatacctagcatcagtgaaccgcccacagtgccgttcactgattttcccaataaggcagcctcaccaaaaaaccggttctctttttgtggcagcaaaggaaggatttcgatgacacctcccatcgcatcactaccgtagaacagtgaagacggacctttcagaatccgtacctcgtctacattaaaagcatcaatttccagcccatgatcggctccccattgttgcccctcttgttttattccattttcggatacggcaatacggttgaatcccaaaccacgaatcataggtttggagaaccccgcaccgatatccatcgagtgtacaccgggaacatttttcaaagtctgtaccaaattaccggtaaaatgccggttcaaataatctttctgaaacaactcaagtgtcagggtagtctttttctcctgagcatgtcggtaagatcccgtcaccaccacttcggataaatctacacttttaatcgtatcagaaactacctgtgcatttgaatacaaggcaaaaaacattcccagcgtacccgaaacatatctgatacgcataaattacaatcatttgatgttgtgaataaataaaagatactatgtaaatcagcaaacgggaggcgcacgtagataataaggataagatttaacctggcaaaccttatccaccgttatttccggctgataatcaaaaaccggaagaacaatatgaagttgtaatgtttcaacttgcgtaaaaggtgaaagtgtgaagttacacacgggacactgatgagaggagtcatgagaatttccactatcagaatggcaaatagcatcttcttcatggtagtgaaaagtcttcaccatgaaaaatggcataagcgtcataaacaacagccatgctataaaaatcctgccttttgcgttttctctcatttttgtgttcagtaagtccactgcaaaaatagaaacaaataacaaaatcacaataacattttatatttattatctgtttcatccactttttacctacaaataggtacatatacaaaaccgaggtagcttcccagtcacctcggtcacggcagatctttattttctagaacagcctacaatccggtcatcctaaaaagagaccaaccactccgtaaatggcagcggccaatattccactgacaggaatagtcaacacccaagccgtcatcaggcttcttgttattccccaccggacggctgaaagacgcttagtagcgcccaccccgataatagctcctgtaatggtgtgggtcgtacttacaggtattttcagatattctgtcagatacaatgtaaatgctccagcagtttccgcaataaccccctccaaaggagttactttggtaatcttagttcccatggttttcacaatcttccatccacctgacatcgttcctaaagaaatggcagtaaaacaagaaaatgccacccaatccggcaaatcattgatactatttatccccattcctaacccttccgaatgagcggcgatcatggcagcagcaataatacccattaccttctgggaatcattcaacccatgaccaatactgaacaaagccgaagaaacaagctgcaatttcttaaaccacatctcagccgtatgcggatgtgcacgacgacaaatgtggaggacaagcaacgtgaatccaaaggcaacaaccatccctataaatggtgccaaaaagataaaagcagcaatcttcaatataatattgagctgaatggcatcaaaaccatgagccataatagcagcaccagcaaaacctccaatcagcgtatgcgaagaagaagaaggaatccccttccaccatgtaaacagattccatacaatagctgcaataacccctgaaagaataatcggcaaggaaatatactgttccactactgtcttggatacagtattggctattccgaatcctccgattatacatttagcaataaagaacgcaacaaaattaaaaaatgccgcccatatcaccgcttggaacggagtaagaaccttggttgacacaatggtggctattgaattggctgcatcatgaaatccgttaatatagtcaaaaatcaaagccaacgtaataataatcactaataattccatgttgtactttctgcttttatgcgtatttcacaatcaggtttctcaagattttccctacccgttctgccgcatcggtcgttttctccaattcatgcattatctccttgatcttaatcagttctatgcaatccttttcttcctcaaatagtttcttaacaaagagttcatatacatcatccgcttgattctcaatatcatgcaattttgtacaacatgctcttaattcagtaggctttttacggaaaatttccaattcatccattgccttacttatataaacagccgcttgctgtatcaacaaactcaactcttttccactattagcaatgggatggggattatagatcgttatgcgtttggcgcaactgttaatcccgtctattacatcatccatagtcgatgccaaatcgtgaatatcctcacgatcaaaaggggttatgaaagtttttcccaattcgtcaaaaattaaatgagtctgcttgtcaccttcacgttccatatctttgatgcgtttataatagttcgctctctcttccggcttatcatgctgcatgctttctaccaataaatccgatgatgaggtcaggatttcagacaaacgtttcaacatagggaaaaacttaggttcctgaggtgtgaatcgactaaaaaaagaatttttcataaatgtaatttgaataaattgtttttgatatgtttgattttagtaattgcgagttttccacttattcctgcctacttctatgacggcaggcaatatagaaacgacaataatagccacaatcagcaatttcagattcttctgtacaaatggaagatcgccgaaaaaataaccggcataacagaaaataccgacccacaaagttccccctatcagattatacaccataaaataataataatgcattttacccatacccgcaacaaaaggagcaaatgtacggactataggtacaaaacgggcaataatgattgtctttcctccgtattttttataaaattcatgtgtcttttccaaatgactttgcctaaatatacgggaatcgggattattgaaaagtttacgtccaaaaaagtgtcctatcatataattacaggaatcgcccagcacagccgaaataaataaaaccaaagcgagaatattaacttccaaaggcatatcgggcaaagccgaaatagctcccgcgacaaaaagcaaagaatctccggggaggaatggagtgacaaccaatcccgtttcgcaaaaaatgattataaacagtatgacataagcccaagtatgatattcttgaacaatatctatcatatattggtcaatgtgaagtataaagtccaataaaaattccattatacattagttattaatacattaacatataacaccattcataaaaggaacaagcatccaccccagttcccattatgaaaatataaaaacaaaagaaatataaggcataaaaaaataggccttgccgaaaagaaaaataagctaaataagaatacgcctcaactgataaatatagtattcactggaatattgggtaaaataaagaataggtgaaaaagaaatttgtttttcttcaggaagaagtactttcaaaaatctagccaacttggctatgacggaagcagaggaatgagttcgcagaattttggaggagcacaaggtgcgaaaagaaaaagaagtagctgcaccgccgataccgactttataaaaatggtagctttcattatttatctcttttttttcctgcccgttattgctttcagatatgttgcacaacgccaccgcactgttttccaaatcaactgtacgaactacatcgtgctcctgtccgctaccaaatgcggaaccaaagcccgccaacagacatacacctaacaagatataaaaaagatatatatactttgtcatagcggctgcaaagataaaaagtatttttgagagataaaatcattctgcctttttcttgcattctctggcaaaaaaagaatataactctgtactacatttcccgaaaaattctccggaatctaagataaatgcaatatatttgtattgacagatatgaaaataatatcaaccccttgaaagaatattattctatgagtactttagagaaacttgacaaagtagatttgcagatactacgtaccttgcaagaaaatgcccgactgaccaccaaagaactggctgcacgggtaagcctttcctccactccggtgttcgaacgcctcaaacgattggaaaatggaggatatataaaaaaatatatcgccgtattggacgctgagaaactaaaccaaggcttcgtggtattttgcagtgtcaaactaagaagactgaatcgggacattgctgcggaatttacacgaataattcaggatatccctgaagtaacagagtgctacaacatatcaggcagttatgactatttgcttaaaatacactcccctaatatgaagtattatcaggaatttatcctcaatgtcttgggtacgattgacagtttgggctcactggaaagcacctttgtaatgaatgaagtaaaacatgaatatggaattcacatttaagtaaatcccatccatcctctcccatcaataccattttttacgcttaaaatagaagtagataactgctactagtattaacatcaatgtccatgcaaatacatagccataccgccaccccagttcaggcatccattggaagttcattccccagattcctgctagaaaagtcaacggaataaatatagtagaaacaacagtcaactgtttcatgatgctgttcatccgccggtcattattggaaaggtaaatatctaccaaagctgaaatcatgtcacggcaaccatctaaagtttgcaatacaaactgcaaatgatcattgacatcattaaagaaaggacggcttgctttgtgcaacagatcattatcagtagtatgcaacaacttgctgatttcctcctttaatggtaaaatacatttctttattacacgaaaattacggcggtattgctgtatattttcaataccaggcatatcagtctgttccggtgaaagcaattgctcttctaaatcctctaatccatcttccaattccgaaatgatggatataaagctggccatcacactgtttagaataacactgagcaggaaatcagactgccggttacgtattttcaacacattcttttccaatgccgtatttatatcattcagaaagtctgtttccttctccataaaggtcaacagataatttccaccttgcacaatggctatttgttgtggcacatagccatcatcattagaaaaaagtaacttcaaaatcactacattatatgtatcatgctgttctatcttagtctgatggttggagttcaaaatatcttgtatcgtcaaaaagtcgacattaaaattctgacagacatgctgtatgacctccgtattctgaaaaccatgaatttgtatccagtttatagcattcttattcaaataagggattaaactatctatatctttcccatcctgcatacaaatactttcagtattataactgcacaaatgcagatgcgtaggagtacaactgacaccaatataagcaagttgctcacttagtaaattattctttgccatagtttcggtaatgagtagtacaaatataattctttttttaaaattcaaccgtgctcctaacccaaaaaagaaaaaattttccccgacagtcctcaacgttttttcaaactaacagcatagatttggaaaactaataccgtaatttccaggagttataccgtttacgcttgcagactataccatatccttttgcgtaatatgacttattcctaattatactgcatcagatgaacatacaaggatcgaaatggttcaatatttcaagtccttcttcaagacaaattacaatacggtaaaaattaaataaaaagaaggcaagtataccctatttctcagattataccagtccgactcctagaaagacatgatctactgaagcaagagagatgattatcaatcttagcaacaggaaatagggcaaaatagtatattcaactattattatttaattaaatgaattgcataaataaaattgttaagaattatggcaactgtaaaagtaaaattacgtccgtcaactgttccaggtaaggccggaactatctattatcaactgacacatcttcgtcaggttaaacaaatcactacgaagatacatcttcatccacaagattgggatagcaataaagcacaaatcattttcacagactcaacctcatacttacttcagtgtaaaatagacagggatttagaccggctaaaaaaaatcatctacaaaatagatgctgaatgtgcaaactatacagttaatgaaataattgaaaaattctatcaaacaaccgccgattacagtattactgattttttcacccaacaaattcaaaagctgaaaaatgacaatcgacgaggaaccgctcgtaattacagcaaaaccttaaaaagcctgaaggcatttatgaaaaatacagattcaacgttcaatattgtaactgaacaatttgtggaaagttacaacacctttttaattcaacggggtgttgtacgaaacaccatttcattctacatgcgcatattccgttctgtatataacaaagctgtaacccaaaaaatcatagaacaaacttttccattcaaaaacgtctatacaggagtggatagaacccgaaaacgtgctgttacagaaacggtgatctctcagcttctctccatagacctaaaaaagtccaaggctctgcaatttgcacgagatttgttcattttcagtttttatgctcgtggaatggcttttgtcgatatcgtctacttaaaaaaatcgaatatacagaatggatatattacctacgtcagacataaaactggtcaagaattaactataaggattgaaaccagactacaaaatataatcaaccagtatgaaaaaaaagactcaccatatttgttcccgatattaaatacagaagatgagaataaagcctactcacaatatgaaatagcgctcaattactataatcgccaactgaaacgtctttccaaacttttagaaccgaatattaatttatcctcttatactccaagacatacctgggctacaaccgcacgcaataaaaatgtacctttgtcaatcatcagtgcaggcatgggacatagttcggaaaaaaccacactgatttatttgacaaagatagacaattcaattatagatgaagtaaataaagctattatcgattcgataaaacagtagttctaagtaagagacggtataaattcgatgcaaagatacttgttttttattgattaacaaaatagataacattttttttctctatctatatataataattatgcttgtgtctaatatttaatactttacgatactatgatagaaaaattgttaaatacaataacattacaaaataaaaataaaaaataagttgttaaaaataaaaaacgaagggctaaagacaagttacaaaagtttgaaaaatcagcttggtaggtatatcctatcatgctgattatattcacattataatattataccatctcttacttagagacagtatgaatttggagttacagtttatttttcttggatcaggaaaaatgctgcgtgctaaagttttcaaattatagaaaaaagttagtttaactctgattactgtgtgttatataacatgcaggaatggaaggaatgtccttccatttttaaagtattaaagataaaaatgacatcaaacaataattcgaaaaaacactggtttgcattaaaagtattctataataaggtttttgccattgaagaacttcttttgaagaaaaagataaaatgttatattccctgcgaaaccgtaaaggttttaaaacaagatggaacaaaaaaaaacgtacgaaaaccagttatcaattcattgctttttttccattcggaaacttacatagcaaaagagatacagaagatcttgaccgataaagtaattctctatactcggcaaatagattttaaaaaaattcctttagccattcccgagagagagatgaacatcttcatgctcgttacctcgtcaggcgaaaaaggtctagaatattttgacacagataatcctaaattttatcaaggagaccacgtaaaagtcattgacggaacattcaaaggtgcagaagggtatatctgtcgcattaaaaagaaccaccggcttattataacagtccatggtgtatgtgctgtagccacctcttatattccgcaagccttcttgaaaaaaataccttaacgacctatgctttccctattaaagaataaaatacgcaataaatttttgcagacagattatatacatccctatataatatggtgtatcgatgtttttttatctgtcatatcctcattttctatctttttatttttccactatttgattaatatcagcatccatttcaaccagcagcgttatattctgctgatagcggtcatttccagtatcgtatggactggaatttgtaagacctacgagggaattatacgttattccaccttagtagaactgacacgtatcatttatgccatgctgctgaaagctctcacatttgttttgtttgcatatataacactggattacatcggattgttcatttattccatcattataacagattttatcagttccgttttcctgctcatgtgtacacggatattaaccgtcaatttctactatcatttattacagcttttaaaaaaacctagacaagcaactttaatatatggtatctccgaaaggggaatcagtctggctaattatctacgaagtgaaaacaatccttataatgttttcggatttatcacccgaaaacccgaaaacaagaaataccggcttgtgggatatcagatatatttaattgacgaagaaaatagtctgcgaaaattattcagcaccttaaaagtcaattgtatattatttctaagccacacagatctccgtaacgatgaagaaatagtgcaatacggtctggagaaccacatctgcctgcgcattgcaccatttttgacagaacaaacacaatggagtaaaatacaattacgcaatatacagatagaagatcttttaagccgggaagaaataaacatcgacttggataatatccgcaatgaattgtccggaagtgttatcatggtgaccggagcggcaggaagtatcgggagcgaattgtgccgacaattatgttgtttcaacctgaagcagctcatcttgtttgatttttcggaaaccgccacttacgaagtagatatggagttgaagaaaagatttccagaccgctccatcctgcctatcataggtgatgtacgcaaccgtgaccgtgtggagtcgcagacaagactctaccaccccgacatcatctttcatgcagccgcatacaaacatgtacccatgatggaaaaatatccatgcgaggcggtacgtaccaatgtcctgggtacaagcatcatggcagatacggcattgaaatatggcgtaaagaaattcatcatgatctccacagacaaagctgtaaatcccagcagtgtgatgggtgctaccaaacgactggcagagatgtacgtacaaagcctcgggagtgctatccaagaaggaaatataattggtaaaacctcttttataaccacccgtttcggcaatgtgctgggcagcaacggcagtgtaatcccccttttccgccaacagattatggaaggggggcctgtaacagtcacgcatccggacatcatccgttatttcatgactattcccgaagcttgccgactggttctagaggccgcttttatgggacaaggaaacgatatctttattttcgacatgggtaaacccgtaaaaataaccgacatggcatgccggatgataaaactggcaggtttacaaccggacaaagacattgaaatcgtctataccggtctgcgaccgggcgagaaactatatgaggaattactctataatgaagagaactctactcctacccttaatccgaaaatattcaaaggtatcagtttaaaacaagattacgataaaataaagcccgccctgcaacaattggttgaggttgcccagacggacaataaaaaagagaccgtatatcagttgaagcaaattgtaccggagttcaaaagtatgaactccgtatatgaggcgctggatgaaaaaacatatatatccaaaaaaatgaaatccaatataatgtttaactaaaatgaatcgcaaaatgaaaaaacatttcattgcgtttatgatgccatttctaaccttggctacgggatttgcacaagaagcggctcaagatgttcctgtcaaacaggatacaaaggagatctcttactggacagaccctgcaagcggggacaaacggctcttaaacaagtctaaattcagagacaactggtttgtcggattgcaggccggcgccttttattcctgggggacccatacttccagttctggattcttcgaccagttccgtcccgccggtgcgttgtccataggcaagtggatcgctcctgccggaggtatccgcctccaaggtttctatggaagcaatgccggacgagcaagcaacgacaagccctactattgggacgccatgggggtaggcctagacggattgttcaacttcaccaacctcttttgcgggtatgaagaagaccggaccttcaacctgatcggtatcttgggagccggttacgaacacaccgccaacttcagcaagcgtacctggaacgacggaatatacaataccgaatcgcaagacctgctgtccatccgcctgggtctgatggcgaaattccgcctcggtaaagcgtgggactttaatcttgaaatcacgaacagtttgcttgacgactcattcgacggttgggaaggcgaaggttcaaacgaccgctgggatggccatgtcaacatattggcaggtgtcagctaccgtttcaaaaatcataacggctcacggcaattcacctacgcccgccacgacatgtcgaaatatgacgaagcaaacgccgaaatcaaccgcctgcgtgaagccaacaaagcggcagctcctcctgtcacaaagattgagacagaagtggtggaaagcaatcatatccgttcgtttatctcgtttgacaatgcttccgccgcaatcaacaaactacaggaagtaaacgtttacacagcagcagaaaatataaagaagctagccgatggcgacctctatatcacttcaaccaaagaagtaagagacaccgaattgttcatggcacgggcacaatccatccgcaatgtgctagccaacacatacgacattccggccggacgtatttttatagagaaaaaccctgctgtcattgcatcgctcgatccacaaaagagctgcgtcatagtgtacatcaatgaataaacgacccattttaaaagtataatttggcatgaaaaaaatagctatattatttgtggtcttcttttgttctgtatctttatgggcacaaacaatagaagacgatgcaacttggaaattaaagaccgacactgtacgggcgctaaagcattacaaggccggtgacaactggttcatcggaattcaggccggcgccaatcattcgctgtccgagaacagccgcttcggatctttcggcaccatgaccagaccaagcatagccctctcggtcggtaaatacttctcacccgccatcggagcacgtgtgcaactcgcttatttgaaacaaatgtcacgcgccaacagcgaagtgattgaagcctttcccgaggtgtatggcaaagggaactacggtttcaatatgttcaacggttatttggacggattgttcaacctgcacaatattttcgcccaatatgacgaagatatccgtttcaatgtagtaggtatcttgggtatgggattcaactccagtttcggattcgatgataaagtcaaagagtgggacaaatcccccagtgaggagtttgccccctaccaaatcagcactgacaacaaaacgtttttctctctacgcgcaggcctccagttcaattatatgttgagcaatgcgcttgacatcaatctggaagcgaccttcaacgcaacggacgatgctttcaacggtacgcgttacgaccgcaaatgggattcatacgccaacgtcatgttaggtctcacctatcatttcaaggaccagtacggcgatcgccgcttccgctacacagaggtgaacgaccaggcatgggttgacgaattgaaccgcaagatcaatgaagagcgtaacaagccgataccggcaccagtcgtcacagaagtgaagaaagaggtagtgaagaacgaaatgttgggtatgaccgtatcattcattatcgacaagtacaatattaccgatatccagaaaaagaatgtggcagaagctgccaagtatttggaagaccatccggaagtcaacctgatcataacaggttatgccgacgtacagactggtaatccggcctacaatttgaaattgagccagcgccgtgccgaagctgtctgcaacatgatggtgaaagagttcggtgtggatccaagccgcatccgggtggattacaaaggtgatagcctgcaaccataccagctgaagaacgagtggaaccgtgttgtagtgttcatcaccgaagcacgcaacaaataattttttgttcataactgaaaatgagtaagatttggttgtcattggcacacatgggcggatccgaacaagagttcgtccgtgaggctctcgaaaccaattgggtagttcccttagggccgaatgtagatggcttcgagcatgacttgtcacagtggctttcaacgcattgcgaccaggaggtacacgccgtggcattatcatcaggtacggcagccatccacttggcattgatcatgctgggcgtaagcaaaggagacgaagtgatctgccaaagtttcacctttgctgcgtcagccaaccccatttgttatcagggtgctacccccattttcgtagacagtgagcctgatacttggaatatggatcctatactgcttgaacaggccatctgcgaccgtatgaaacagaccggcctcaagcccaaagccattcttccagtacacctttacggcacgcctgcccgcatgaacgaaatctgtgacattgcctcccgctacggcatccccgtggtggaagacgctgccgaagcaatgggggccgtttacgacggacgctattgcgggaccttcggtcaatatgggattttctcttttaacggcaacaagatgatcaccaccagcggtggcggcgccttattatgccatacggaagaggaagcccagagagtgaagttctatgctacccaggcacgtgaaccgttcccctggtaccagcacgaacagatcggatacaattaccggctcagcaatgtgtcggctggtatcggacgcgggcagatgcgtgtagtggacaaccatatcgcacaccgccgtgccatccaccggctatacaccgagctgctggcaggacttccgggtatcactgtggtagaacccaagaaatctaccatgtttctacccaattattggctgactacaattaaagtggacagtaacgaaaccagtttcagcgccttgcagctgatgcagcacttggcaaaagccgacatcgagacccgtccgctttggaaaccgttacacctgcaacccgtattctcatcctcccccacctacgtcaacggagtatcggaagccctgttcaactgtggactctgtctgccttcgggatcaatgatgacgtgcgaggatgtgatgcgtgtagcggatgcgatacggagtatgagatagataatttatttaataacagacagagttctgcaagaacttggctatatgaaagtttcatagtaaagagaaaattgtaagatgttaggaatttggagatggaacgtgaacaagccgaaagcgacatgtcacatccggatatttatctccgtaaatcggtaaagactgtaaatcacagtcgtttcatcctttttattcttgattcttattgattgagttcttgcagaactcggtcatgtttttctcttttcaaacttttgccctcttacagaataagaagtctggcaaaacaagaaaaaaaagatgacaaagaaagtttatacaaagccggagctgaaaagcgaggctttcgtgccgcaaacgcatgtggctgcttgtggagatagtggaactgtttataagtttacttgtgatgcaccaagaggaacgttgtattattttagagataagcctgcttctggttcacaacccactataggaaatcgaggtatttggctaggaaactatcatccatgtagtgcatttcatgaagccgaagcccaatctggtttttattggggatatgttgattacaaccataatcagatatttgagaaaagtgaattagtcattgtttggagaggacaaaagggctgggagggtcacgccaccaagaaccttgacataaattcttgggaaactgctaaatcctaatcggtaaataaaacagtaaatagcaatcttattcatttatttcaatcttgattcctaacgcttagataaatttattgattctcattaatagaaatagagattaaataatatatgatcagactactggaggaactaagtcagaatatcgtttgagctgcaaagaattagtgtaatgaaaaggaaaatgaaaggatcatattgtagatggtaaatcgcaatatatcaattatttcaaaattctttcacaccggagtttctccgggacccaatcactatttcgcttcaaaccttttctgatttcctttcctccgaaacaggaatcaaaaaagaaaaaaatagtatgaagaaagattatcaaaaaccgatgcttattagcgaagagttcattccgaacgaatatgtagctgcatgctataactttaaagcactatttcattgtcattatggagaaaacaatacaaacaatcatggagaaccatgcgctacaacctatgtagatattaatggtatccatgctacagggcacgaagggactatagaaaaatggggtatacctattctcaatattgattggaatggattcgatttaagtgacgcaaaagtaggtgacaagattagaggcatcaagtggactagctatgatacagtaaataacactggagaatacaatcatcaaggttggggtgaaatcagatctgctgttgaagaaataccaggtcgtcctaaccactcttaagacattcccctatttatgaaattcgcatcaaataacagtatagacttggaccttaaaagtaaagtctatactgtaaacctctcaaattagggttctaaaatatctatcttcgctgcgaatcaaaatttacgaattatgcaaagcaatgaagaccttgaaagattctactttccctatctttgggtctatcatcgtaaaatatagacttggttgtatgccaatagttaaaaatcaatcgaatttgataatatctttttgtgagatgccaattctggtgccttataaaaaggatatgctctaaattaagtattaacttttgttgagcttcaaaaagggaagataatctatatattttccatcgagacaaatttcggtaacatatacgaccacggaagtaaatgaaatccaatacactagactcaaaaacttttctttgaaaaaaaatcattatcctagtggaatccctgcaagacataaaccctgtggaacgggcattggtgaacaaagcgacggcaaaccgtactccgatcaatgccactattgaattgacaccgacgtgcaatttccgttgtgatatgtgctatatccgcatggagaagtcacaagccgagaaaagaggaggattacggagcatagaggaatggctgcacattgccgaccagctacaggaaataggaacgctcttcatcttactgacaggaggcgagcccctactctatcctgatttcaaagaattatatatccggctgaaagaaaaaggattcatcctcaccatcaatacaaacgcgactttgatagatgacgaaacagtacgtctgtttcaacgtttgaaaccccggagggtgaatgtctcgttatatggtgtgaccaacggaacttatctcaatctgtgccacgcgacaaacggtttcgaccgttgcctggaaggactgaaacgattaaaagaatatggcatagataccaaactgaacctcaccttgacacgacaaaatataaaagaacaccggcaaatgctggaactagctgacgaatgggacttacctatgctgaccaacagttacatttcagtctattcacggccgggatgcgccaccacgctaccccttgatacgtgccgccccgtaccggatgaagtggcacatgccgaggttgaggcactggaacataaatatggcaaggaatacacatcatacgccactcatgtcctccagcaattggaacgtggagaatctcccgtacctgctgaaggcatcggacttgcctgccgggcaggtaaaagttccgcatggatcaactggcagggcgtcatgactccgtgcgtcgatatggaaacaccagccgtttcgctactttccacaaccgtaagcgatgcctggaaacaaatagtaaccaaatgcgaacaacttccgttccataaagaatgcgcaggttgtaccttacgctctatctgtgatgtctgctatgccaatgcccgcaatgaaaaagagcaatgcggcggcatcggctacctttgccgcattgcaaaaagtaaaaagaaacaaatgaaaggaagtctataaagacttttctcataaatacatatacattccaagttatggatcatcttcacgatgccaaccttttggaacgggcattggtggacaaagccaatcagagccgtgtcccgatcactaccaacttcgagctgactcccacctgtacgctcaactgcgacatgtgcttcatacgcaccgaacgcagcgtggtggaacggcacggaggtttgtcgcctttgcaacaatggctcgactgggcagaacaacttcaagacatgggtacactcttcatccttctcaccggaggtgaaccgatgctctatccacacttcaaggagctgtacacccggctgcgcgaaatgggattcatcctgactctcaatacgaacggcacactcatcgacaacgaaatggtacgcatcttgcagacccacaagccgcggcggataaacgtcaccctgtatggagacagcagagaaacttacggacgcttgtgccacaatccgcaaggatacaccctgtgcatggaagccctgaaacggttgaaaaaggcagacattgatgtgaaactgaacgtaagtatcgtacgaaagaatgaaaaagattacgacgagatcatccgtctggcccagcatctggacattccggcagaagtaaactcatacatgtttcctctctcacgccccgaatgcggaagtctgcgtaacattctaactgaaagactggatgccgacgaggcggcccgcatcgagatgcaatatatggagtacaaaaaagggaatgacatggcacgatacatgcacgacttgaaatatacgcttgcccatgtggaaggaacacgagcctgctctttggagtgcagagctgccaagagttcatgctggatcaactggcaaggcatcctcaccccctgtgtgatgctggatcaaccggccgttgacctgaaaaagattccgatgacaactgcatggcaacaacttttagaagaagccaaggaactggtatcccataccgaatgcgagggttgccaccttcgtcccgtatgcaacgtatgctatgccgccgcacactgtgaaaaaacaatcaccggaagcatggactatctttgccagatggcgaaagccaaagaacggatcattacgaattatccccccgtaatacattaaaaactgaagattgtgagactgaatatcggcccgctaacgattgaattgtcaggagtgacagaacaggagattcctgttaacagccgtttgtttctcgaccataaacccgctaccaaagaagcggaccggtactatacattctattttgtcaaccgtctgcctttgccgtccaacgactggcagatcacattccaacgcaacgacatcgtagttttccggaaggaagaacaagaaacacgcctgctggctgtaggaaacctgaatgcctgctatgctctctatcaggaaagaaacgaaagagatgccaacatctatttcatcgaaggtctgaaaagagaactgcaaacagataccctgttcatttcctgcctgtgcctggaacgtcctttatctgtccagggatgttacatactacattgtacttttctggattatcgtgggcaagccatcttattcagtggtcctagcggcattggcaaatcgacgcatgccaacctgtggtgccggcatattcccggcacccaggtactcaatggcgaccgtgccctgctctgtccacttccaaacggcgactacgagataacgggatggcctgtatgcggttccagcggtatctgtcacaatgaacgccgcccgttggaggccattgtattcatcgaacaggcatctgataacaccatccgtccccagacagccatgaagcatttcaaagctctctgctcgcaggttacaatcaactggtggaatccaaagctcaccggcaaagcactcgacgatctgcaggttttgaccagacagacaagcatcagcacctatgcgtgcaacatgaatccggaagcagccttcaccctgcacaggtatctgaccaaactggaaattatccgataatgtgaaatacgccccattatgaagactgtcgatacgaaagaatacatatccatgctgcgtaccctcattgaggaaggaaagcaggtgagcatgatcatctcgggcagcagcatggctccattcctgatccacgcaagagaccacatctgcctgaaaagcccctccggtgaacttcggaaaggagatatggtgttctatcagcgaagcaacggtgaatatgtcatgcaccgtatttataatgttaaaaatgaagaatattatcttatcggtgacgcccagactgtcatcgaaggtccaattcaaagagaacagattttcgccatcattatcaaggtgaagcgaaaagggaaatggatagttccagaagatttccagtggaaattcttcgcccacatatggccgaacataattcctttacgcaggaccatcattaaaacatatcgttttttcaaaagatgaaaagaaccaaagaatttatcaaacgaaacatagccggagaaatcgtactggttccttccggacagaccgcccgagagttcaacggaatggtcaccctgaccgaaaccggagaatttatctgggagcatatcgaagaagcagaaagcttcaaccatctagtactgttgattctggaggaatacgaagtggataaagacaccgcatcgcaagatgccgcaggatttatcatgcaactgctgcaagccggcatgatccgtcccacaggtataaactggtaaacagtaatctgttcaattcagatatgacaaacaatacaataagaaatgttagaagagagattcgttttcttcgcgagaagcgccggatctgtaaaaaatgttagatcaggtaagttcaagaccctatgttatcagcggataatagaatgaacttacattttattccccattacatctgcctgtgaaggtcgatgtaattttaactataaataggataatgcaataatataaagacaatgagactcaattctaatttaattcttcgccaagtaggtggagaatatatgattgtcaatccgttttctgaaaccatggatatggcacaggtctattccttgaatgaaacagccgcctggttatggaaacaattggaaaacaaggaattcacggtagatgaagccggagcactgctgtgcaatgaatatgaagtaaataaagatacagcccgaaacgatgccaacgagctgtgccgacaatggttagaaactgggttagccatagaataagacaaaaagatgatctcagccccattacaaaaggctttcatgcttttgctaaggcaaggactgtgggaccggcaggaagactgttccgccctttttcctctagatgaaaaggaatggaatgaaattcacagcatggcaagaaaacaaaccgtacaaggcattatttacgatggcatccgcctgttgccgactgaagccgtacctccccggaaggtattgcttggctggatggtggaagttgacaccttggaacgggtgaaccggcaacaccgggaaacgattaaagccctccaacagatttatgtacaatcaccttctatccctttcctgctgctaaaagggatagggacagctgacttctaccctcatccggaacatcgcatagccggagacatcgacctgtggttcggaaacaagacacaaaccgaacaagccaaccaacggatggaaaaattaggattaccgataaaaagaggaaccaatggtgaggcttcctgtctgataaacagagttctgattgaacatcacagcaggctgatagagttgcacaaccctttcctccaaaaagaaatccgccaatgggaagcgggggtctttaccaacagccaaggcaaacttccgagcgaagcgaatcatctattactttccacccacatattgaagcatcttatcaatgaagggatcggactacgacaattgtgtgatatagccatggcttttaacgcattacattctgttacaaacaaaaacgaattagagtgtatctgtcgcaaatggcacattcaccggtggaaccggttactttatgccctattgataaaatatcttggcgtgccggccgaccttttaccattcagtaccagtctctgtccggacaagttaatgcaagagatttgggaaagtggcaattttggacatggagacgaacgttacggtgaacgtcccaccgggaaatgggcgaacaaacgatacacgttgaagcggatctttcacaaaatgcacttatcgttaggttatgctttcgacgaaactttctggtggctggccggattagccctcttacgtttcaaggaaatgataaaaaagaaatgaaagaattgctgaaaaaatttttgcagaagctcacacgggagaatctgagcaatacatgtcagttaggatggaaagctttcaaatgggttatgcaggtaacagaaggataccattggctcatcaccttctctatcttttcgggtattttcggagtggtcatgtcattggtcaatgtggccatgtccaaatggatcatcgatgtagctaccggagcacaggaagggaatatttacctggtagccacaatagtagccttatccttcctgctgggtatggggataaaacttgtatctccctggatttttggcaagatcaacatgcgcatcagtatccgcatgcaaaattcgctgtccgacgccctaatgatgtgttcatggaaaggagcagggaaatggcacacaggcgacctgctgacccgtatcagcagtgacgcttccgaagtgttgggaatgggaatgggcattctacccaacctgctggttaccggcttgcaattggcaagctcttttatctacttgtggattcttgacgcgcgtttagcttggttcatactgggagtcacccctcttgttttattgtcaaagatttatttcagaaaggtccgggaactgagctgtgcccaaaaaaagatgaacagcgagatgggtaccgtcatgcaagaaaatctgtccaaacggattctagtccgctcgctcggagccaccaactaccggaaacagaaattacatgaaacacaagagaagttgttcaaattgggaatggaacaaatcaaattttccacttttacgcaaggggtcatgggatttacatttggaggagggtacttatgtgcattcctttggggtattttccaactgcataaccacgagataacattcggaacaatgacagcctttcttcaactggtcggacaggtacagggaccttttttagggttaatatccatccctcccagtctgatacggggatggacctccgtggaacggttaatggccctctttgaagatgtagaaccggacgaacacccggtctacatagaccaaccactgacactgaactttcggaaagtgtcttttggctatgaagagggacagccggtactcgaccggtttacagctgcctttcatccgggaagttccaccgccatagccggacctaccggaacaggaaaaacgaccattatccggctgatactggctttggtttatccggaaaagggacgcatcgatttgacaactgatgacggacggacactcagtgtgacccccgatttacgcatcaacttcgtctatgtgccccaaggaaatacgttgctgagcggtaccatccgggagaatttatggctgggtagtccgggagcagacgaagaggctctgcataaagtcatccggctggcctgcgctgaatttgtgttcagtctgccggaaggactagataccaagataggggaacatggatatggcttgtctgaaggacaagcccaacggattgcaatagcccgcgcactgttgcgtcccgggcggatctggctgtttgatgaagcatcatcggcacttgacaccgagaccaccacacacctcatggacaatttgttgcaatggggaaagaataacacattaatatttgtgacacacgattcacgactgatggaacgatgtgaccaagtgattcatataaaggaataaaaaacaattaattataaaacaatggataaaacaatcaaactggcctgtctgttggcaataatcatttttagttcgtgcgcttcacgcaaagattttgtctatttacaagatatggatgaactacaggaatatcctatggttcaaaaatatgaagccatcatccatagggatgacagattgagtattattgtgaacagcaaaaacccagaactgtccctgcctttcaatatgtccggaagcagaagctattctgtagaagcagacggaagcatttccaacaatgaagtgggggtattaagtgatgaaaaagaaaaaggttatttagtggatatcaacgggaatatagactttcctgtgctgggacaactgcatgtggaaggactgacccgccgacaattaaccgaactgatcaagaaacgactgatcaacgaagaattgctgaaagatcctatggtcaccgtcaatttccttaacttcaaattttccgtgctgggagaagttggacatgtaggaacctttgaagtgaaaggcgaccgcatcactcttctggaggctcttgccatggccggagacctgaccccccgatcccgtctggaccgtatcgccgtcatccgcgaatatgggaacaagcgacgaatcctgttccacgacatccgcagtaaagacatcttcacatcgccttactattacctgcaacagaatgacatcgtttacgtagaacccaccaacatgaaggccaccgaacaggcccagagaaaactgagcacgtggagtatgatcctgtccttcatcaccacaatcacctcactggtgttgttaactactaaataaaaaagaaacgacatgataagaatgagtgaacaaaaagatatgtcgggagataagaccttaagcgggggaggattcaatatcaaccccgttgacatcatcatgtacctgttgtccaaatggtactggtttgtattgtcggtcagtctgttcggcggatatgcatggtatcaatatgccaaacttccctttatctattcacggtcagccaccgtcatgataaaggacgcctattcaaacaacatcggtcgcgggctggaccgttttaacacctattcatataccaatgtatccaatgagatcctgcaattccagtcacacaaactcatgcgcgatgtggtgaaccgtcttcacgccaatgtatgctacctcatcatggatgacttgcgtgaggaggaactttatacgcaagcccctgtcaaggtttcattcccggaagaagaggatcatcttgatttcagcctgacagtcagaatcctgaacaggaagcaagtccggttatccgatttctcgacagacgccacaagtataacgctgacggccaatctgggtgacactatccagtcgcccgtaggaaaaatagtggtctcacccaccttatattatacagacaagtggttcaacacaccgattacgatacgccggcagagtacggacacaatggccagcctattcagaagcaacctgaacatcagccaagctgagaatgacgcctccatcctctacctgtcactccgtgattactccaccgcccgtgccgaagatgtgctcaatatgctgattacagtgtataatgaagagactatcaaagacaagaaccagatagccatcaatacctccagcttcatcaacgagcgtctagtcatcatcgaaaaagaactgggaggcgtggaaaacgaacttcagtcctacaaacagaacaatgacatcatcgatatcggttcagccgcttccatgtccatgtcagacaaacggcagtacagctcgaccactcaggaactggaattacaggcacgcatggcacgctacatcaagagctacctggtggacccgtccaaagaaaccgagcttatcccttcaaacaccggcatagccgacatcaacattgaaacccagataacggcctataatgccaacaagttgaaacgagacaaactgatagaaggaagcagcgacaagaatcccatcgtccaggaactgaacaagaatctgattgccatgcggcagaatatcatccgggccatcgacaatatgattgtcagcatcgatgtgaaactgaacgaggcacgaagcagggccggagaagcccagtggcgggtaaccaacatacctagacaacagcagcaaatgctttctatcgaacgtcagcaacgcatcaaagaggaactttacctctatctactgaacaaacgcgaagaaaatgcgctgagccaggccaccaccgaaactgacgcccgtgtgctcgatcctgctggaggaggggatgctccgatttctcccaacggacgcagcatgatcatggcaggtgtcatgaaaggaatcgccctgccggccattgtcctgctattgttcctgttcttcgatacccgtatacgcaaccgcaaggacatcgaggatgctgtaaccgttcctttcctgggcgaaatacccaaggattcatccaaagggaaaacagagaataaagaaacggcacatggcattgctgtccgtgcccaagggcgtgacattgtatcggaagccttccgcataatacgcaccaacatggattttatgcgtgtcaagtcaaagaacatgcaagtcgtcactttcagctcgttcggaccgggtgccggcaagacatacgtatccagcaatctggcagccagcttcgcgcaaaccgacaagaaggtcatcctgattgacatggatatccgtaaagggactttgacttcacatacccgcctccacacaaaggaaaaaggaatgacctcttttctggcaggcaaggccacaacggatgaaatcatcaagcacaacgagatctgtgaaaatctggatttcattccggccggtcccatcgcccccaacccgtcagagctattgctcagcgaacaactggaagtactgataaccgaactgcgcaaccgttatgactatatctttgtcgacaatgtgcctgtaggagtggtggccgatgccgccatcaccaaccgcatagccgacctgaccatcttcgtggtacgggttggcaaactggaccgccgcatgttaccggaagtggaaaaaatttatcgcagcggacaactgaacaacatgtcgttggtacttaacggggccatagtaaagacaggcggatacggaggctatggatatggttacggctacggctatggttatgtggatggttccgaatcatgctggaaacggctgttcagaaagaaatcctaaaatccccccaaaaaagaagtaggatgtttggtatattcaagtccaaatacaatttgattaattctggtttaatgaagggtatgaccgatgtccattcccatgttcttccgggagtggacgacggttcgcccgacataaatgccagtctatccctgctgcgctatatggaatccatagggttgcggaaagtgtggctcaccccccatatcatggaagattatcccacaccgaacaagaagctgcgacaacagctcgacgtgttgaaggcggcctattccggcccgttggatctacggctgtcttccgaatatatgatggatgccgcttttacaaacaagctggatggagaagtgctgcctttgggcagcagccacctgctggtcgagacatcctacatgtaccctcctcccggtttgccggatatcctgatgaaagtatggaatgccggttatcaaccggtcatcgcccacccggagcgttacctgtacatggaagaaaaagattaccttctgctgaaagagaaaggttacagctttcaactcaatctgatgtcactgagcggttactatggcccgcaccccaaagtggtcagcgaaaagctgttaaaacaaaaaatgtacgattttgtgggtacggacctgcaccatttggagcgttaccggcccatgcttgaccaattgaggttgacccgaagacaactcgaagctttagaaggtctgattgctaacaatgcgcgtatttaactgtctgtcgggaggtatcctgtgcggtctgacactgctgttgatatttctcccctgcttcactcccgagtgggccggaaatcttatcttcatcagtctatcggcgattcctatatgtatagccgatgggattattttcgcgattctgctttggaaacataatcgttggtggatgctttacttgcttttgctattaggtagttcacctattctatccggttactttccgcttcatttcctacatagagaagaagtgccagattccaatcagctaaaactggtttgctggaatgccgaagggttcagactgaacaaagacaccctggcgaaggccatccatagcattcgtatcctgcagcccggcatcgtctgcctgcaggaacgtccccataccaatcttctggcatgggacaccatccgagctgcttttcccgattacccctattgcatcgtcaactcgcgggaggatgaaattcttaatctggccgtcttcagccgctggcctgtcggaaacgttcaagagtactacttcccggacagctacaataagatgcttcaagcggatatccggatgatagggcaaactttccggttattcaacgtccatctgcaaactaccggcatgaatgaatcatcctcaatgaaagacagactccagacgatgcgccaccacgccatccggcgtaaccggcaagccgatctcttggcaaacgccattgccgagagtccttatccggtcatcgtgtgcggtgatttcaacgatacaccggcttcgtatgtttaccggaaaatcagccggtcactgcaggattgcttcctccaggccggccggacatggaaaggcagctaccaacgctggggcgattttttacgaatagattatacgctctgttcacctgcattccaagtgaattgttaccaactggtttccaatccctggagcgaccacaaacagcagcactgtgtgctctatctggacaaacgctactaaaaaacaagatttcaaaaaatgactaaagaaaactggacaatagaaataaagccaaagaaaaaatggctggatatagatctgaaaggtatatggcggtaccgtgacctatactatatgtacgtgaaacgcgacattgtcaccgtgtacaaacaaactattctgggtcctctctggttcctcatccaaccgatcttcactaccgtgatgtatatgttcatattcggtggcctggcaggtatctcgacggacggagtaccacagcctttattctacatggcaggtatcatgctgtggaattatttcagttccgcgttcaacgtatcctccaatgtgttcacggctaatgcgggcgtgttcggcaaagtctacttcccccgtctggtcgtgccgttgtccggcatcacctccaacctaatcaagttcggaatacaattgttgttgttcattgccatgtatctctatttttatgtgaaaggagcttcactgcatgtcaatgccgccctgctgttgtttccgttcctgacatttctgattgcattccatgccatgtcgtgggggttgatcgtatcggcgctgaccaccaaataccgtgacctcacccagttggtcaccttcggcctgcaactgttcatgtatgccactccggtcatttatccgctaaacgcagctccggaaaaataccgtgacatcatcgcgctcaacccgttgacccccatattcgagacctttaaatacagctgcatggggtgtggttcacttgattggggcggattggcatatagcactttgtttatgctctccaccctgttctgctcagtagtcatcttcagccgggtggaacgcaattttatggatacagtgtaagcagcagaattaaaaaaagagaataagaatgaacgatatagcaatccggtttgaccatgtgggcaaactctacaaactcggtctggtcggcaccggcacactgagccacgacctcaaccgctggtggaaaacgaccattctccgccaggaagacccctatctgaagataggcgaaaccaacgaccgcagcaagaaaggcgcgtcggaatatgtctgggcgttgaaagacatcaccttcgatgtgcatcaaggcgatgtagtaggcattatcggaaaaaacggtgccgggaagtccaccttgttgaaacttctgtcgcgtgtcacctcccctaccaccggagccatccgtgcccgtggccgcattgcctctctcttggaagtcggtaccggtttccatccggaactgaccggccgtgagaacatctacatgaacggctccatcatgggcatgactcgccacgaaatctcccacaagttggacgagatagtcgactttgccggtgtgaaacgctatgtagatacccccgtaaaacgctattccagcggcatgaccgtccgtctgggctttgccgtagccgcttttctggaaccggaaatactggtagtagatgaggtacttgccgtaggtgatgccgaattccagaagaaagctatcggcaagatgcaggacgtgtcgaaaggcgaagggaggacggtgttgtttgtgagtcataatatgggtagtatgcaacggctatgttcacgtggagtattattggaaaatgggaaggttaaatatatgggaagcatatccgataccatccgtacttatcaaagtgatgaaatcattcaaaactcatttgaaggaactgacggaaacaaacaaatactctatttgaaaaaagcctctgtttcatccagcgatggaaacatattctacaattcttctactattaaaatagaatttgaaatatgcgtaaagaaacatattccttctttggttattggatttaatctatatagcatcttccaatacccactggcacgagccgactacaatgatgagaacaaaaagacatcgctagaaccgggaagttaccactttactttcgagattcctccttacaccctatccaatggagaatataaaattgtttttgatgtggcggaaagaaatgtaaagtgctacacaacaaaaaagtcgcaattgacattcaatgtacttcaaggggaagattgcttcggtaatgtatttgcagaagatattcccattaagtcttctcttatcagagaaaattggttgaaagaaattaaaacatattaaatcagcatgaaattatctgtcgcactttgcacctattaatgatgaaaaatatataaaaaaacaattagaatttattctaaatcaaacattacctatagatgaaataattatttgcgatgatcgatctcaagataacactatacaactaattaaagaattaaagatacgacaaaaaatcattctttcagttatgaacgttcatttattaatcgtttttcaactaatagaaagataaaaaagtcacaatatcctaattcacaatatagtatttttcatgtcgctgagtttttataataaatggaataaacttcaaccatctatacttttgggagattggacatatgaattcataattaaggaaagattaaaaaggaaaccatattgaagatacaaatttctcacacttatttcaaattataaaaaatgacaaaagatctcgtatcgattggaatacctgcatacaaagctacatatttaaaagaagccattgactctgttttaaatcaaacttacacaaagttcgaactgatcatagtcaatgacaaatctcctgagaacatagaggaaattatttctacatataacgacaaacgtatcagatactataaaaatgaggacaatttagggaaaacctccattgtcctaaattggaacaaatgtctttcctatgctaatggtgatttttttgtactactatgcgatgatgacattatgctaccgaatttcattgcaacgatgcttggtttagttaaaagccatccacaatgcaatgtctttaaaacaagaacgctccttattgacagtaaaaccaatacaaacataggaaaatctcccttgtttcctaaatatgaaacatttgctgatttcctttcaaatactattattggaaaaagaaaacatacaatatcggaatttttttataggacacaacatattcaacaattaggagggtatcaaatttatccggcaggttattatgctgatgatgcttccatcttacttttctgcaacaacaatggaattgcatcaacagaagaaagcctaatagtttatagaaaaagtgaaaataacatttcttcaagctcatgttggaatgtagaaaaatccaaagctgctttaaagtattatcaatggattattgatgaattccccatgaaacaacaagatgagcaaataatacaacaaagacttgattttgatttgtatacttatttttcagcagcattaaatattcatcaatctatccaaatattaaattgtattccagtcaacatttggaattggaaaaagaaattattatgtctttacaagttcatattaaattcttatgcaaagcaaattaaataatcttcttttcctcatcgaatccctatctggcggtggggcagaaaaggtattgaccaccttgttgcaacatctcgactcgaacaaatttgatgtcacactatgttgcatcgtagattgcgggaaatatgtaaacgatgtaaagccatacgttcactatacttctatattgcccaatccagaacaaataaaaggaataaggaaactgatttatcaactcaaatacaaattaatctattcgtggcttccgttacgattggtttacaaatggtttgttccacatcatgcagacgtggagatcgcttttgtggaaggatttgcaactaaactattggcacattctactaataaacaggccaaaaagatcgcttgggtacacactgattttgaaaaacatcattggactaatgttatatttaagaataaacagaatgaagaacagacatatagccgatatcaccaaattgtcacagtttctgttactgtccaaaaagcctttataaaagctttccctttagtaaaaagtttagtaaaaatcatttataaccctatagatcacgaagacattataaaaaaaggaaagcaatacgaacctttgccttccaaaagcaaaatacgattaatcagcattggcagactgaccaaagttaaagcatacagccggttgctccacatcgctttacgtttgaagcaatccggatacgctttcgaactatggatattgggagatggtgaagaacgtgaaatgcttcaacattatatctgcaaaaaacagttggaagattgtgttactctatggggattccaaacaaatccatacgcctttatgacacaatccgacttgtttgtctgttcttcaatcagcgaagggtatagtactgcggtaactgaagcacttattttggggcttccggttgtgaccactgattgctccggtatgaatgaacttctgcaaggagaaaagtatggcatcattacagagaattcggaagcgaccttgtttgaaggtattaaacaactactcgaccatccagagcaattgtcacattacaaagagaaggtaatcaaacgagggaaggaatttactttggaagtattgatgaaaccaattgaaacattattaactcgatgaaaaaaaagatccttttctttactaacggactttatggtggaggagctgaacaaattctgctgacgctattaactcatattgattatacattgttcaacattacattatatagtctgaccaaagatgatgtaacaaaagagtatcccgagcaaattcattacaactacatcttccatccaattagcgaccaagacaattgctggagacgaataactaaaaagatcattaataaattcaaacacctaatctatcatcacttttctgccaaattgttttacgctctttttgtcaaagggaattacgacaccgaagtagcctttattgaaggatatgccacccgaatcgtttctggatctaacaacaagcgatctaaaaagatcgcttgggtacatactgatttaaaaaacaatcattggacaactatagcatacagaagctgtcaagaagaacaagagtcctatcaacaattcgacgaggttacttctgtctctttggatgtaaaaacaagtttcgacctattgttttcccatcccaacagcacagtcacttacaatcctattgatgaaaacaaaataaaactactagcagacaaatctatcaatccaatttgctggttagaacaaggattgataatggtcactatgggaagattagtaccacaaaaaggttacgaccgattgcttcctatcatcaaaagattaaaagacgaaggttttcgtttctcactaaatattttgggagaaggaaccgacagggaaaaattggaacagtacatcaagcaacaccatttagaaacatgtgtccgactaagcggatttcacaccaacccctatccttacttggcaaaagccgatttatttgtctgttcatcgcgggcagaaggatatagtacagtaatcacagaagcattaattttaggcttgcccattattacaactcgctgtgctggtatgcaagaattattaggagaaaatggtgagtttggacttatcgttgacaacaatggcacatcgctatacgaaggacttaaaaccctattgtcaagtaatacctgcttaatgcattacaaacaaaaatctcaagaaaaaggtagacaatttgctctaaagaatttagaacaaaaagtctacgagaaattgtagtaaaaagaacaaaaaactcattctatcggattcgtacgatgatttctatcataatacctgtatataacgtaaaactctacttagacaattgtattcaatcggttatccaacaaagctatacagattttgaatgtatcttagtggatgatggttctacggatggtagtagtgaaatatgtgaccaatgggcagaaaaagataaccggattataattgtccatcaacccaatggaggagtatcatccgctcgaaacaaaggattggaacaagcaaagggagaatatatctgttttattgatagcgatgactgggtagatgttgattatctttcggcaatgataaacaatttgaaagagaaagaaactgatttgataatatgtggattgactcaggaattcaaagacgggaattgcatagattatatacctcaacagtcactaaatttcgagttaggctgcaatcatacaaactattttgtaatgctgaatgaacagaacttattgtacggaccaattgtgaaactatacaaaaacaacatcatacagcatcatcaaattttgtttgacccacaagtttcatacggtgaagaccttttattcaactaccaatatttggaatatgcacacaccattgcgtgcataaacgaaagtcattatcattatcgcatattaggtagcggaaccttatctagtaagtttcgtcccaaacaatttgatacagactatcaacaatggaagatattacagtctttttatcaaagacatcatttatggtcatcaacggctcagacttatctgtacaaacgactgtggggtattctatacgatggaatttttctctatccacgtctgcaaaataaaaaaatctcttatctacgaactattcttgcgataccggaaataaaaaaattgaaagattttacacaatgcttttcgtgcagcaattggatcaagcagtccattctgtatcggttatatcctatattctatatttatttttcaatcattgccaaaagatgaaacttttattatatcctcacggaggtagtggcaaccacggatgtgaagctattgtacgttcgacactaaaaatgataccgacagctactctattttccagcaacccggatgaagacaaaagatacggtctggacgccatctgtactcttcgggcagcacaagcaccaatgtctcatctcagtttggcgtactggaaagcctttatacgttatcgcttcggagacaaagaagcgttcgaccgtaccagttttcgctctatttttcaagaagccaactcagatagttatgctttgtctatcggtggggacaattattgctacggagtgcctgttttcatttatttggtcaacaaacagcttcgaaaacaagggataaagactatcttgtggggatgttccgttgagccggaagttctaaaaggcgatatactgaatgatttacgttcctacacccatatctttgcccgtgaaagcatcacgtatgaagccatgaaagaaaaagggatacaacaactctctctctttcctgatccggcttttcagcttaaccgtacagaccttactttacccgagggttttgcagaaggtaatacggtaggcattaacgtcagtcctatgattataaaacacgaaaaggcgaaagggatgacacttctgaactatcgacaattaattcgttatattattgccaccacggatatgcaaattgcattgattcctcatgtagtatggaactataacgacgatcggatcccattgcaattcctctacaacgaattcaaagggaccggtcgtgtcgttcttatcgaagatcataacgccgaggaactaaaaggtttcatctcccgttgccgttttttggtagcctcacgcacacacgcttccattgcagcctactccactcaaatacctactttggtgatgggttattcggtaaaggcacgtggcatagcccgcgacctgtttggtaacgaagagcattatgtcttgcccgtgcagtctctgcaacagggaaacgacctgctcaaagcatttcaatggttgcaaacacacgaggacgagattagaaaacactaccgtacattcatgccgggatacttatccaagacattccaagccggacaattgcttcaaacattatgattctaatggtttacatactcaccttaatagggacaatagcccttatattcttttccgttgattggactattgaactatacaaatggcaaagtcgcatccacattggtagatggacagaccgcaaagcatggcagcaagctgttgaaaaaaaggcacgccaatggctatacaaaagccctaccgtacagattacggatcaagatcggttagtcctttgggatatgctaaaagggaactatcgttccaccaccatacaaagctggcaggatgccggactccttttatccttgcccgaacaggacgcccaagagtatgtcaaacgccacccctcgctattcataaaagaaaattggcagatagaccaatcgctattggcgtatgtcttaaaaaagaaagatgcactttatatggaaacagaaaaagagattaaagaacactttatatcttatcaacaaactgaacagactataccttatcggaaaacattacctcacattcgctttgtcgataccatcggattggtttgtccctttttacaccaatgcgatttcagtgatttagccatccgacaaattgaagaatacgatcattgcttatgggaagaagtatttcccccacatgcatacgacttagcctcacataagcccttgggagtatttgattgggcacgcggatggggatggtatgtcttaggacttatcgaaactgccgatttacctggaaacaagaaacgaatactaaacttgagtaaccatctgctgccttttcagaaagcagatggaggattcagttgtttggtattcaatcctaacgaacgatttgaatcttcgggcagcgccttgtttggattgttgttcgttcatgcgtaccgagtgtctggtgatgaacgttacttgaatgccgcaataaaaattgaaaaagcacttatgaaggctacccgtcgagatggcacgatagattttgcacagggagataccaaaggcattggttcttattcacaaatatttgatcgaatgccttttgcacaaggaatgggactgtatttatctaaaacattagatatatatgaaaaaactattggttgacatttggaattgtttattcgactgttacttgacagttcgaaattcactctatctctttatggatattccatatcgaaaagttgtaatagctcctcacgttgtatccattgaagaaaccatccgatacatcatccaatcgcattgttcggtcagccgtttaggagatggcgaaataaagatagctaatggaaaggcactcgctttccaaacccaacaaccgttactacaacaaaaaatgcaagaggtactgtcggtacctatttccaatcacatcgtatgcctgccggatatatttacagacttaagcctctacaatatagaagcgcgcaaccactggaaacttcatttggcattttacaggaaatcgtggtacaagtatatcaatcgtaaaagaatatttcataatgctttcatcagccgttgttacatgatgtttgccgacaaaacacagtgtgccttttattttaaactcatacaacaaatctgggcagacaaagacattctgctcattgaaggcgaaaaaagtcgattaggtgtcggtaatgatttgtttgacaatgtcaaatctattcgacggatattagcacccaatacaaacgcctttgatcactatgatgccattatgaaaatagttcagaaatattctcctaatgaatatctcattcttctggctttaggccctactgccacagtcatggcttacaaccttgcccaaaaaggataccaagccattgacatcggtcatatcgacatcgaatacgagtggtacagaatgggagcgagccacaaagtacccattccaagcaaatatgtcaatgaagccgatgcaggtgtaggagtgggcgacatccatgatgaaaaatataaaaaagaaattatatgccggttttaagtatcatcgtacctgtatataatgttgcaacttatctacgagaaggattggattccatacttaggcaagaagttcaagacatagaagtgatttgtgttgacgattgttcatctgactcatcgcccgacattctgaaagaataccaggcaaaggacaacagaatacaatttattcgtcaatcagaaaacaaaggtccaagtgccactcgaaacatcggcataaaatatgctaaaggaaaatatattgcttttttcgatccagatgataaagtggaaaataatctatatgccgaattaattcatgctattgaggataaaaaaaccgatttggctttatgtggttattctacattccccactcatcagatacacataccgaatttcaaaccataccatgccatgcaacctatggactttattcaaaagaatccaagaatagaaatgaataacgatttatgttatacttggaggtttgtattcaaacgtaattttcttatcaataaaaaaataaggttcattaaaaacctgcatgtcggagaagatacagtttttaattatgaatgcgtcctacaggcgtcttcaatcataatgattccaaaggcattatatcaatatcgtatcaataatgcaggtagtttgatgaggctgcgttataagccctatttaacaaacaatctacaaaaattggttgatgaaaagaaaagacttatcagaaaatacaatattgaacattacatccccataacaactgacttgtctgaaaaaatcatcctgcgttatttgccgatgcttttcaacaatctatataataattctaatcaaccggacaagaagcagggcattcaacaaattttatcaatgactatgatacgagattccttccgtattataggttttcgcaacatttatccttcatggaaagaatacttattctatctggccatgaagttcaaatttacacgattggtttgttatgaatacaacaagatatttacaccagaaaaaagagtataataaatgtcaatttattgaggcccactatatattaaacagcttacacaagccttctgtagtctttatggtattagggacattatgctcctatacatacaggaacaagtaccttcacgaaggttcggagcgatgatagtcgaggaggaaaattcatgtttcctacgtgaaccaaagtaagatatgttcgtggaccaagttaagtatcttactcggccaagtaagatatattacttgccctacgaagatatgttcctttttagcagagcatttttattgtcttttccactaaagctcttatactaatgagggaaaaggtatggctattcaattccaccaagagatgaaagacagagattatcccacaaaggagccggtgaggaatccccagcaaagcaatgaacaagcgaatccaatgggacaactggaaaaagaaaatccgtttccggatcctataggattgactccgagacagcgatccgctctgctgcggcgccacgcgcttcatcagaaatacgacaaggctgttgccctttatgcggagacagacatgccactgaaaacgatagctacggaatgtcacgtctcagcgggaggactcggcagttacttgcgccgctactggcgcgaattggtattacaccgccatcgcatacctttggaaggagaaaatccccatgccgtcaagatcatgtccgagggaaagcccaatgtggtgtcgcatgccagatataaaaaggctatagatgcatgcttgtctctggaggatatcgaattgaatgtgtcgcagatagcccgcaaacatggagtggagggaacgggactagccaacttcatgcgcatccatgaaccggaagtcattccttggcgcgagaaagtacgccactggttgggcataaatgacaacacccatcgtggggcgaccccggcttgcaccaaacaatacgccgaagcagtggagctttataaaaagacagacatgacgatccctgaaatagccggggcatgccatgtctcaccaagcggtttcaaacagcatctgaggttctatcacaaaaatatactggaacaaaagagaaagaaacgttcggaagcacaggccagaccagagaagaagagaggcgaactatccggcaacggaaggacctacaaaccctctctccgtacagaagataaatatgcgaaagccttgtctctttataaggacacggctctcacgctaaaagaaatcgcagaaagaacacacgtcacagcggaaggacttcgttcttatctgcacaaatggcatatcgacttagtgagggaacgggcaggactttccggcaaggcagaagggggtcttgatttgcggaaatcgaaaaagcggatgaaaaccgtagccgccaaatacgagaaagccatcggaagcctgagaaaacacccccgcccgatagcccacgccgccaaagagttcgggctccatcccgagacattcagagagtacctgcacaaacatgaaccggagttggcaaaccgacagggtatggtacagacctctgaggggaaacggatgtccagacaaagcaaagaaaaatatgctgaagcgatccgcctgtatgggacgaccaccgaaacactgaaagacattgccacccggctgggattgacatacaacagtatagggggatatatccgccgaaaccatccagaggtgatcaatgcacactctacattattaatagagaaagatgaaaaatcagtcatcacatcaaaatagacagccaatcaaacatggcacaacgcctccccgtattttcatcgccatccaatacctggagataggcggggcagaacgctcgctgatcggcttgctcaatgccctagactattcgcgttgccaagtggatctgtttgtctaccggcatagcggggaatttatgaacctcatacccaaggaagtgaatcttctgcccgaagtaaaaaagtacaccaccctcacccgccctatccggaaaattatccgcgaagggtattgggacattgctgccgggcgcatcgcagcacaccttttggactggtgttacaggaaacggaggaaggcaaaagaaagtcaggccatatttcaatatgtagcagactgtactactccattcctgccctccatcaacgaaggccggacgtatgacctggccatcagtttccttacaccgcacaacattgtgcgcgacaaagtaaaggcacagcaaaaatgggcatggattcataccgactattcctttattgacatcaatacccgccgggaattgccggtatggggagctttcggccgcatcatctccatttctgaatcggtttccaaaggttttctttcaaaattcccttcattagaatgcaagttgatactgatggaaaatatcctgtccgaaacttttatacgtgaacaggcggaactgcccttcgacacttctttcctacaagcattcgaaggacgagaaggacaaacaaaacatcctgttctgctctgtaccgtaggacggttctcttatcctaaagccatcgaccgggcagtgtacatctgccgtcaattggtgcaacagggcattgacgtttgttggtatgtcgtagggtatggcggagataaaccgttgatacggaaagcgattgcggaaacggggatggaaaaacatttcgttttggctggcaagcaaatgaatccctacccttacatcaaggcatgtgacatttatgtacagccttcgcgttacgaaggcaaagcagtaacggtgcgtgaagcgcagatattgggaaaaccggtggtcattacccgttttcctacctcctcaagccaactggaagaaggggtggacggcattatcatcccaaacaatgtggaaggagcggctgaaggattggcacagttcattgccgacaaacgacaacaagaagccatcaaggcacaactacgaatccgccattatgggaacgaaaaagaagtcggtaaaatttattcagcaatagaaggataaaaagaggaaacacatgatcccgagaacaatacactattgttggtttggagataaggaaaagcctgctgaagtactccgcatgatagcgaactggcagaaacattgtcccggttacgaaataaaggagtggaacgaaaataacttcgacatccgtctgaaccgctattgcgaagaggcatacgctaccaagaaatgggcttttgtgagcgatgtggcacgtttgtgggcattggtacacgaaggaggtgtctatatggacacggatgtagaattggtacgtcccttggataggttactgacgaataaggcctttttaggattcgaaggaactcaatgggtaggaacgaacctgataggagcagaaccctcccactctttcttcattgaattattaaagtcatacgatcatcgctgtttcatcaccccggatgggaaaccggaccagaccaccaacgtagaagagctgacccgcaaactggaaaaggtttacggattcagaaaggacggcagttttcagcagctcggagacatcactctctatcctacggattatttctgtccgtatgattacatcgacgggcagttacaccgcaccgaaaatacatattccatccattggtatagccagacatggatcaaacgaagccgatggataaacaagctcagccaatggatgcatcggctgacaggaaatcgaatgaaataaatgtcacaatggaagaacctatcagaatattgatgcttttcaccatcatgaaccggggaggtgccgaaacgatggtcatgaactactaccgtcacatagaccgcaaccgggttcagtttgatttcatggtacaccggcaggaacggggcgcatacgatgatgaaatagaggcaatgggtggcaagatctaccgtatgatccccctccatccgttcaccttcaatacatacagaaaacaaatttccgactttttcgaccaacatccggagtatcggattatccatgggcattgttcggaatcgggatatttcgtttaccgggaagcagcagggcgaagagtacccgtaattattgcgcacgcacacaacgcacacgctttattcgatactaaatggcttttccgcacctatttcaagcataccatgcgcccttacctgacccaagggtttacctgtgggaaagaagccgcccgatggttgtttggaaacgagttggggaaaaaagcgattttgcaacgcaatgccatcgacacgttcctatacaggtttgatgaagcggtgcggctggaggttcgtcaagaacttcacttgtccaaagatgttacggtcgtgggacacgtcggacgtttcaaccgacagaagaaccatgagttcctcttggaggtgtttcataaatatgtgcaggagtttaatcccacagcacacctgctgctggttggtacgggggaattgcaaaaagccattcaaaaaaaggtacaacagttccgtttgacagaccaagtacatttgttggggggacgtccggatgtaaaccgcctgttgcaagcgatggatctgtttttgttcccctcttttatggaaggcctttccgtttctatggttgaggcgcaatgtgccggcctgccctgcgttgtgtccgatcgcattccccgcgaagcggctttgaccgaccaagtctccttcctctcattggaaacagctcctcgacaatgggcatgcgaaatagagagagtgcgctgtatggcaagccgacgcactggttattaccaacaaatagccgatgccggttacgacattgtgaaaaacgccgaatggcttcagaattattatttaggacaatggaacaaaacaagatagaaacagataagaagacgctgaccatcttcacgccgacatataaccgtgcctatactctgcatttaggttacgaagccctgtcacggcagacctgcaaagatttcatctggctgattgtggatgacggttcgaccgacgatacccttgaatgggtggaaaaatggatagcagagaggaaaatagacatccgctaccattatcaggagaaccaaggaatgcatgctgcacacaatacggcttatcggttgatcgacacagagttgaacacttgcgtcgactcggatgattatatgcccgatgatgcagtggagaagattatcacattctggaacgcacacggttcaaaagaagtagcaggaatcatcggactggatgctgatttccaaggaaatttaatcggtacgccttttccttatgaatgcaggcggactactttaggcggattctatgcacaaggcgggcggggagacaaaaaactggtgtatcgcacggatgtcatcaaacaatatcccgaatatcccatttttgaaggagagaaatatgtatcactcggttataaataccaattgatagatcaggattaccctttactggccttgaacgaagtgttggtaaacgtagaataccgccccgacggttcaagcttgaacatgtaccgccaatacatacgtaacccgcgaggctttgcttttatccgcaaaagttccatgcaactggctcctacctcacaacgacgtttcatcgaagcgatgcactatgtggcagacagtttgttggcacgaaatccccattttctatcggagtcaccacgcaaatggctgaccctatccgctttgcttccgggaataacctggtatggatatatacggtataaagcacgaaaattatcatgatcagtatcattgtaccggtttataatacagccccttacctgccccaatgtctggattcgttagtgaaccagacttatcgggacattgagattatttgtgtaaatgacggatcgacggataattcaccggatattctgaaagcatacgcggaaagggacagccggatccttgttatccatcaggagaacctaggactatcaggcgctcgtaacaaaggtctggagagtgcccgtggagaatgggtgatgtttgtggacagcgatgactggataggaacagactgctgcaaaacacttctttcacacaccgacaaacaaacggatgtctgtcttttctcttacattcgtgaatttgccaaccagtcctttcctcaatatctgttcagcgacaaaaagatggtttatcaaggatcttcaatccactggctctatgcgcgacttatagctcctaacgatcaagaattgcgtttgcccggaaagatagacagtttgtctacagcttggggaaaactatataagacatcactcatcaaagaacatggccttcggtttgttcctgtcagacaaatcggtacagaggacttactcttcaatgtgtattatttcacttgggtaaaaaaagccatctatctgcctgacttgttctaccattatcgaaaaaacaacatcacctcgctaaccaaactgtataaaccccatctgactgaacagtggaacctgttattccggttaatagaagaatggataactcccttacaccgggaagaccttgaaaaggctttaacatatcgccgggcattaagcctgataggacaaggattgaacatcaccttttcaccggtcagcttcatgaaacaacacggtgcattgtccgcaattttgagttcacatgaatataggacaagtatccggcagttaccgatgaactattttccgatacactggaggctattttttgaaatggcacgattccggtctaccacaggagtcttgtgcctattgaaacttataaaatttattatagaacgatgaaaatagcatattgtacagatagtatttgctatgcaggagggattcaaagagtcacaatagccaaagcaaataaattagctctaaagaatgaggtttggattattgtgaccgacaataaagacaaaccagtattccccctttccactaaggtacatttggtaaattgtgacataaattattttgaagatgactggaaatcccgtttttatatattgaaaggtattatctataaaaggaaacaacataaaaaacggttgaaagagatactgaaccaaatacagccggatattgtcatatctaccggaacaagtgagaaaaactttttaccttacctgtcggtcagctcccatccggtttttatcagagagatacatagcaataaaaattacaggtcattacatgcccaaagtgtattcgacaaactccttgccattttgggagacttcattgattatcgcatacaccttaaaaaatatgaccgaacggtggtacttacaaaagaagataaagttgtccattggggaaaaaatacagaagtggatgtgtgtgtcattcctaatcctattatttcatttggttcgaaaaaagcttcattaataaataaaaaagtaattgctgtaggaagattggcatttcctaaaaatttcagctcgttaatttccgcatggaagtatgtaatagaaaggcatgctgactggactttagaaatatggggtgaaggagaattaagaactgaattggaagaacaaataagaaacaatcaattgacaaacaatattttcttaaaaggatatacttatgatatattttccccattatatgaagcgtcaattttcacattaacttcgctttttgaaggtctcccattggttatcatcgaagccatgtcttgtggagttcctgtcgtctcatacgcttgcccctgcggaccgcaggacatcatagccgacgggcatgatggatttctcgtacccgttaataacgagaaggtattggctgacagaatctgccggttgatagaggataaagaacttcgtaaggaaatgggaaaagccgcccgtttgaaagcagaacagtatgatataaaaaatatcatccctatgtggatggaattatttaatcagcttatcaacgaaaaaagaaaatgaaaaaagatatagaaacggatttaataagcgtcatcgttcctatttttaatgtagaagcctatctccgcccatgcatcgaaagcatattggcatcaacttatacaaccttgcaaatcatattagtgaatgacggttccaccgaccattccggagaaatttgcgatgaatatacccggaaagacacccgcattgaagtgattcatcagaaaaacgcaggattgtctccggctagaaatagcgggatgaaagctgccaaaggaaaatacatctctttcattgacggtgatgattatatccatccgcaaatgtatgaagtgctgttggaagcattacaggaaggtaattatagcttttccatgattttaggaaaacaggtatatgacaatgacaaatcttattcaattccttccgcttacacaaaaagcattcttacacaagaaataatgataaaaagtttattcaaccatatccacccacagcaaggaataaaagaagttcaagcgcaagtagtatggaacaaactttataaacgggagttgttggataatgagtttttccaagagaccggtacagaagatactgagttcaactgccggatctatcaaaaatcttgtcaagctgtcataatagatatccccatgtactactgggtacaacgacctacgagtatcacacatcaaaaggtaaatccccgttacatagaccgtgccgattcctactatctctgcttgcaaaacattccaaaagaaaatacagtttaccggggatgttgtttggaaaagcttttcaagatgataatcaacgtgaggtatcatgcgtcaaacacgccttaccggcatctggcacaccttacagcgaaaagactaaaaaagcaaacagccaacgagttcctgaaaaacagacatatcccctttcatataaaactttcactcctcagtttctattacattccgcccctgtacagcggattcatgaaactgtgcgagacaaaagcacgaaaaaaataacataacgaaaaaacatccataaatatgatagactttatccccgtaagtgaatatgcccattatttcgatgtcaccgtattgtgcatggtactgacagccgtatggcagtgccacacaggaagcgtattgaaaaaagagaccgtgtcgctcaacgccatgtggggcgtattatttacactaatcctgatcttgtatatggggctacgtcctgtcagcgtttatttcggagacacggtaaactacgccaaaggattttatactgcagccaattcatgcgatcccttttcctggcaatgggaaggcgaatggttgtttcacaaccttatgcaatggtttgccaaatacagcgacatccatactttttttctgttatgtgccactgtctatatcggttcattgtggctggccatgcaacgtatcttcaaagagtattactatattccttttttagtcatactcagcatgtttactttctggagttacggagtaaatggcatccggaatggcatgggagcctccttgttcatcttggcaatgacgtatgtcaaccgtccacctgtaatgatcgggttatgcgtgttggcagccggaatccacaaatccatttatctgatggttggagcaggcacactgacctggttcatcaaaaacagctattggtatctggcaggatggggggcatgtgtaggcgtatcgtatgccgtaggcggacgtatccaagcatatttggcggcaacaaatctaatggggggagacaaccgcttttccggctatctgacaggtgacaacatggtgggcgagatcgtccagatgagtatgactttccgctgggactttctgttatatagtgccatgggggtagcagtgggttactatttcatcttccgccgcaacttcaaggacgaatattaccattggatatataatacgttcctcgtcaccaacgctttctgggtgctggtgatccgtgccgcctattccaaccgtttcgcccagatttcgtggttcatcatgccggtggtgttgatttatccgttcatgaaggaacgtttttgggtgaaccatgaaaagatgttgggctacgcgctgttaacgttctatgcgtttacgttttattttaatatttggaaataaattaatacattcatataaccatgatttcaattatcatcccaatttgcaacaccgaacaatacatagcacaatatattcggatgactggctggtgaataaaaaaaaatacttacaacaatatacgaaacggcagaaaaaactggagtagactatgtggaaatgggaatgcaacgagtcatggatcgctatggggtggtaaaaaaacgggactcagtcctgttaacggactaatacaacaaccaaaactatttaacaaatactatatttctttttttggaatcaacattttatccgttaatatgtggggaaaactctatcgaaaatcttcattaaatgcagccaatatacagccaacaggtatcactacaggggaagaccttgcctttaatctccaattatttccatatttatctaaaatttacatactcaaagaatgtggatataactatcgattcggtggtatgacaactcgatataacacctgtttgttgcctgatttgaaaaaactttattacataaaaaaggctttaattgacaaatatcaatatcataaggtttctgattatatccgaatagaactgaaaaatgtgctaaaatcagatatttgccaaatgatagcttttaaagtcaggtctcctaaagaaataaaaaacagaatctcggaagagttaaaggaccctatatacaaggatatcatgcaagtacaaaatcatcctgcatttttagaagatccttttataaaagcaattgccgcctacgattccaacatgcgatatgatctatgtaagaaacaagttaaaaaagaaattccaattagattacttaaaaaaataatttcattcattcttatacatatataaaaaatctcatgtttatttcacttgctatcaatccaacaacctatatcgttatttttcttctcttaggggtggtcctaaaatctaaacgatggaaaaggctctgtctcactttgtcagccttgctttttctcttattctccaacggtgcactctatcaatggattgccgaacaatggtacaaggaatatgaccgccccctacctgaaaggaaacaatatacatacggcatcgtgctgggcggctacagctattgggactggaaacgaagccgacccgaatttagcgagattgccgaccggttattagaaggcatccggctgtacaagcatggacgcatccggaaactggtgttagcttcagacggttcgatcatcgaaagcaaagacggaaaaggtttgcaaggaaatgccgcggacatgaaacaatatctggcagatttgggcatgccgttggaagatgtcatcttggaaacccgcgcaaacaacacgtgggaaaacgcaacgttcacgttagagctgatcggtaacagtatgaaaacggaatcgaccctgctgattacctccgcgacccacatgcgcaggtcgctatggaccttccatgcagcggggctgaatccggacacatatatcaccgatacgtttcccgaaataaagggggaaaaaacgaatttcctgccatcttggcacgtcttggcttcctggccagaactaacgcacgaatgggtggggtatctttattatcgtttacgacacaaaccatctgtatgaaacccaaagtaatacgcatatccaccgttcccctttcgctccatctcctgctgcaaggacagttgaagatgttggcagaaacttatgaagtattagctgtctcttcgtccggagaggaattacacaaagtagcggaaagagaaggcgtcagaacttgcgctatcccgatggagcgccacattgcccctttgaaagacttgattgcactgatcaggctcatcatcctgttccgcaaagaaaaaccgcagatagtccactcgctgacacccaaggcggggctgttggccatgatggctgcccgaatatgcagggttcccatccggatccacactttcacaggactagtattcccttcaactacaggttggaaacagcagttattaattgctacagacaaactcacttgtgcctgtgcgacctacctcaatccggaagggaaaggtgtgaggagagatctggaacgtttccatatcaccagccgggcattgcatcttatcggaaacggtaacatcaacggaattgaccttgcttattttgaccggacaccggaggtaatgagacaagcggaaatctatcgccggaacccctgtttcactttttgcttcgtcggacgattggtgcgggataaaggtatcaacgaactggtttcagcttttgtccgcctacaacaggaatttacaaactgtcgtctttgcctagtgggagactttgaagcggaactggatccggtaactcctgaaacagcagaacatatacacaaacatcccgccataaaatttatgggatggcaagaggatatccgcccttttttagccgctgcggatgccttcgtattccccagttaccgggaaggattccccaatgtaatattacaagccggagcgatgggattaccttgcatcgtaacgaacatcaacggatgtaacgaaatcattgaaaacggaaagaacggtatcattattcctcctcatgacagcgaatacctatatcgcaccatgtgcggatttctctcttctccacggctcgtagaacaattggcctcggctgcccgcccacagattgttcaaaaatacgaccgccggacgctatgggaagccttacgaaaggtctatcaagaacagatttcaaatctaacaaaataaagactgacaatatgtatttatacggagccggcggacacgccaaagtgatcatggatatactgaaagaaaacagcactgaactgacgggcatcatagatgataatccccacatacaggaatggatggaatatcatgttctttcctacgatccaaaacgaatgttcccgatacttatcagtatcggaaacaacagcatccgaaaaaatatagcggaacaattgtataaaaaaaacgctgtattcggtacggtcatctctatccatgccattgtctccccctatacaaaaataggagaaggcagtgttgtcatgcaaggaagtatattgcaaagttgctgccaaacaggtaaacattgcattgtcaacactggcgccgctattgatcatgaatgtatattggaagactatgtacatgtctcgccacacgccacattatgtggcaatgtggaagtgggggaaggctcatggataggtgccggagcagtgatcaaccccggagttaaaataggcaaatggaccattatcggatcaggatcagtagtgtgcaaagacatacctgacggagtgacagcctgtggttcaccgtgccggattataaaaaataatccacaaccatgaagaagagcagatatacccgttatttcaaatatccgctggactgtcttatagccgcctttctgatattattgacctctcctgtcctattgtcaaccatcttgttacttgccatagccaacaggggtagcggcatttttttccttcaggaacgtccgggaaagaacggaaaaatattcaggatcatcaagtttaaaaccatgaatgaccggaaagactgtcgcggaaactttttacccgacagcttacgaatgacccccatagggaaaatagtccgtgccacctccgttgacgaactgcctcaacttttcaacgtattgaaaggagacatggctctgatcggcccccgtccattattggtacaatacctgcctctatacaatgaagagcaagcaagaagacatgaagtgcgccccggcatcactggatgggcacaagtaaatggaagaaacgcaatcagctggaaaaagaaattcgaactggatatctggtacgtagaccatgtttgcttcatgacagacatgatgatattttacaaaacactcaaatgcgttatcagccgcaaaggcatatcccaaaagggagaggcaaccacgaaaccatttgacggaaacaattagggaggagttgaattttaatgggactttttatccgtaaggaatgtgtaagagactttggaatcagactcgccctaaaaagatcttattcgtatccctaaacctttcctgccgtatggttaaggtcttttttcctgtttgttttatctccacaagtctttggagttatctccataagctttggagttaactccaaagcttatggagatagaaagtatccgtataaaaaggtttaatctggagaaagaaaagacttaggctataagaatggaatgtgatatgcattcattttattccgccgatggggttgttacttttttaagaatctctgtcccttggatttcatggtaacggaaagattaaacttattgaaaagctcttgtcggctcctttcacacaactctgtatgtgtgtataaatctaaagaaaggtatggacggggaaaatccctatccacacttcatttctactgcccccccaattaacatctacatgtttacatggagcaggtaaactagcgtaataaacataaaatcagagaattactttgatataactccctgaccttctagtgatccgcttgggttatgaaccaagcgttatttcttcctcaatatcagtgctttcagaaatttcggctttgcatccgtcacgctttagtccttaaaaactgtctgctgttgtccggtgtctgtctgccaacatcttgggttcaaatgtacgcattatttttggattatgcaaaccgttgagaataaacattctaaggttagtgcaaggtgcaagctatatatatagatatatacttgcaccttgcactaaattttaatacttgtttttcctcctgttatccattatcgtttcaaagttttcttgcccccattgctttagatgttccaaatgagggattaaggtttttccaaattcagatacataatattccactttgggtggcactgaagggtatatttttctactcactaatccgtccgttaccaatgaacgcaaaacggtagagagcattttttccgatatagaggggattgttttatatagttcattgaaacgtattaccccattctcgtgtagcttcaacaagacaactaaagcccacttgtcgcctaaccattccaatataggggatgcagaacagtattcataatctaacttttttcgcatttttttcgttcttaaaatcattgatattgagaaaaactaacccaaacgtaagtggctgacagatagtatagttcttctttattcaaaaagaacgtcctaacttcgcaacacaaaaataaggaaaataaccgattccaagtgcttaattgataattatatggaactattacattttacaggacaagtgtggcgaccgccttacgaggcaagttctcaactattacaggttacagccggatgcacacatagcaagtgcaaattttgtagcttatatcacggaacaaagtttcgtctatctcctattgcagaggtagaggaagatttgaaagtgatacaagactatcaaccaagggcacggcgagtatttttaaccggagctaatccttttgctttaagctataacagactattagatttaggtcttctaatcaggaaatatcttcgctattgtgaaagcattggtatgttttcccgaatttcagatattaaatcgaaaaccgtagaagaattacaaaacctgcgtcatttaggtttcgacagtatcagtatcggaacagagtcgggcgatgataatacattggctatgatgaataagggatatacagccaatgatattattgagcaatgtaaaaaactggaagaagcaaatatcagatacaatttcgtgtacctgacaggtcttgcaggaagaaataaaggagaacaaaatgctgttaatacagctaatgtctttaaccaactacacccgtttaccataaattttgtatcattgaccgtatttcctgaatcagaattatatcaggaaatacaatgtggaaattttgtagaagcaaccgaacatgaaaggttattggaactaaggacattcatttcaaatctttgtatagaaacaaccctgttgggaaatacggtatcaaatacagtcccatttgttggaatgatacccaatgataaagttagaatactcaatgaattggattctgccataaaaaatgctggtgaagatgaattaagactatatcgggatagtattgtatctctataaataactactacatgaaagagaagatttgtgacatattatctgaaatagacttagagattgacgaaatcgacctctacggctatgatattatcgaaacttctctttcaatggtacatagattgcaaactgttcttagtgatttaagaacgaaaatacaaacctatgtatttccaacaaaagaggatgaaatattatttttcaaggtacaaaaaccggaaatacttgggcggctgctatttttctataagatatacaggattgaaacacaatgccctaatggaagcgatgaagttattaaagggtatattagtcgggaactggataacttgacctacttctttaaccgtaatctggacttttaccaatattatcgctctcattcaatattgtatgatgaatattattttgtccgtggaaagtctgatttacgcctatgtaccgatagcgcacaattcgataaagacccgaatttctcaaccggatatgattataaggtggctaaaataatagccaatgaaatgctgcgtatctatctgaacaaaagactggtaaaactggaaaccaatacccaagtagaagacaacctgcaaaagtgtctgaaatatccttttcgtttcacgggtaaaaaagtctttttaatagaattggggtattcccttgtttcttcgggtgacattaacaatgggaacgtggaaataaaagaaatgatgaacttcctcggtacggtgttccaagtggagttaggcgattattatgctgcctatattgccatgaaagaacggaagaaagaccggacggcatatcttagccgtttgcaagaaagcttagtcaaacgaatggatgaagatgatagtaaatgacaggtttctatttttcttttcgccagtgttatattgttttcattcaatccaacctgccatattgaaatcttgctttcaatcaatccagccatcaatatttcaataaaacaagattgcaggattgcaaaataaactcatcggtcggggaacgcccagcggcaaggggcgggaccacccgtcccgacgagcgaaaatctttagttagtgaatatctttctttaattggcaacacgacttcggagtgaatttgcccaaggtgttttgcggcacggaaaacagatttgtgtgccacaaatcacaccttgctgttatctggcgataacacgatttcaacgactggcagtccggtgtggaatgtccaacttttgagccaacatttccatgtcactgcttaccttcaaatcagtaatcctcgcatagatttgagtagtcctgatgttggtatgacctaaaatcttagataccgtttcaatgggaacaccgtttgcgagcaacaccgaagtggcacacgaatgccggtgtcaatgcataagtaacaggaaagcaagcgataacagaaatgagtagataaaacttaaacagttaaatgtttattcttcaaacggttatattaaaccgttgaaaatctaaaataatactttaatgattaatttcttgttccgttccatccctcattaacccccacgcaaaaatcatcccaattattgtatacataaattgcagcaccagccacagcaagagctaaagcgacccatccaccattcacttcttgcatctcattcacattcatttcctgcatcaaagcactattttctaaatttttcataatagtattttttttattagttaataaattgtatttatctaaaagcctaccagcagataatatccgctaatggtccatatattttacgaagttgttccatctgttccgcagcaggaggcatacactctcccgatacctgtacatgttcctcaccactgagtggcttcaccatgcaataatcattttttttcatacttcattttgtgttttattgttatatactaagaaaataattctctaaaatagctccaagaacattcatatacagaaactgtcatattacattaatatccgtactatttccctttatcatcttctttttttcttacactaatattaagtatcgctaccagaaaaagaaagcatacgggaatcaacttagcccggtctccctcatagagaaataaagctatagcaagtaaaaatactgatacaatatacagaatactctttttcatattcaacagaatgttgccacacctactaatgctccactgtatccacccaaagcttcacccgaaacagtccggctcctgtcaaaataccaagacctgcaccaccgaccgcaccagctacatatttagcatactgagtaattagggttgtttcgatgcgacaaatataaatctactttttcaaactctttgttatcagattattatctttagattaatgttaaatcgtcgtacaagacatatcatttatcatctaaaataatatcctccgaaaaaaagtattgctgcaacaatccatattatcagcaaagcaataaaaattctttttgtccagctatatgctttttttaaactgatgacataggaaacatctgactttctattctttttccaagcctctatactatggtataaaggaattatgcctaaaacaggacacataaaagttagcagaaccgataataaaaggactgttgatatatgttctttttccatactgattgttattttaaaatgcacaataaattgcactgcctagtactccaccaacagtacatgctccaaaaaacaaatcgccaatatcacatgctatagggtggttattctcataaaaatctttataattttggtattcatcattggcacactgataccaactagcaagacttcttgtttttactaaattttcatcatcaaattccaattttatatctttcaaggtattatcagatatatataatgttgcaaatagtacttcatcagtcgtgtagtgataaagtatataattattttcgtctatattttctttcaccaaaatagcatcaagttttatatctctattatcctctctataaacagataaataaaattgttctatatttcgacctgaggcacgagtgatataaggaacctctttgcttttcaattcataacctagtccattttgtttgatatcaataatcacagtacttttcctttctttttccatcacagattcggaattactacaactaaagaacaacaatgtaataaagcaagcgcaaaatgattttgcgattttaaatacaattcttttcatattcatatagttttctattaatgcaaatcaataggaagtactgatactgatttacattagttaataaaattgtacttatataaaaacctaccagcagataacatctgccaacagtccatatttctcatttgttccgctgtaggaggcgcataacctcccgatatctgtgcatattcctcgccactgagtggcttcaccatgcaataatcattctttttcatacttcattttgtgttttgttgttatatactaaaaaaataattctctaaaacggctgggtactacaaatacactagtcagactagtactgctactgtaaatgtagcatccaccataaatattcatacattctgctaacgtcagcgttttcatttcatttaattcttatcatgttctgtgttcgtgttattattttccctatttcaatattagggcaatctctgattcttcttttgaacaagcggacagtaaaaagtggtataccggtcatgtgatttacgtccccaccttgttcgtttatactcgttttttccatatctctctttttgggtttgttttgatgcgacaaaggtaaattgcttttttctaactctttgttattgaagtgttatctctatgttaattgtttatatatctgggtatacacttaccttcttcattcaatacataaacaactcttccttcaccaccataaatattttctttttctccttttctcaattctaaaataatattttccataacttattgttttaatttaaatgacttacatttgttttacattgcaaatatacaggctatttttataataaaatgttatccgattgttatctaacattagaaatatgttattatctttgcaaaaaaataaacatgaaaggtagacacattaaaatactcactatttttggattaatagcaattatagctttacaaactatatggttatgtaatgcatatatacagttttcacaaagtatatataaagatagtaatgacattttaaagaagtccttaaacagggaagcttctattagatttgaaaaaacacctaagggaacaatgataaatggtgctccaataaaagattctaacgaaattgtaccggaaatagcctatttgaacgaaggattattaaaactaggattagaactatcattaactaatgttgattccctcgccaatgatttcttaaaagctactaatattgaaagtacaataactatctacctactgaatactgacacagaaaaagttctgaataaaagcaagaatgatttagatatccattcattcgggattataaaaacagatataattccgatccggacagatttatcacaaggtgtgcaaatgattttaataaacccatattacacaattattaaacgtatggggttactgctaatagcaactgtcatattgatgatttttgtaataggatgtattgtatatcaaataaaaatcatcgccagacaaaataaaatagcccaactcagggaagatttttcttatgccatgattcatgatatgaaaacaccactcagttcctatcacgatgtgtactagttttctgcacagtggaagactggatgacaaacctgaaatgaaagagaaatattttactatcgtagaaaatgaagcagatcatttattagcattgaccaataagatacttacattatcaaaactagaaaatcataaattggaaatgaataagaaaaaaatctcattcgaacctattattgaggatttaaaagagaagtttataacaaaatctgacaaacccattcatttcactattgatttaaaagccaaagaagtatatgttgatgaagaattttttaaagaacttatgagcaacttgatagataatgccattaaatattccaaaaagagtattgaaataaaaataagttcgcattacgatgataaatataccattataaaaatatatgataacggaatgggtatctcagagaaagatcaaagaaccattttcgacaagtttgaacgtgcttcagcaactaaacgcactaaatttggtggagctaccggatttggattaggtttaaactatgtttatcaagtaattgaagcacatgaaggaaaaatatatgtaaacagcatagaaggagattttacagaatttactttgtttatacctaaaattatggaggaactatgattaaacttttattagtagaagatgatcccactttcagttatatcgtgaaaagtggattacaggaaattattggtggttatgaagtgataactgctatgaatggaaaagaaggattgaaggcttgggaagaatatcatccggatatcattatttcggatattgacatgcctgtaatgaacggttatcaaatggtagagcgtattcgtgaaactgatggagatactcctattttatttgcttccgcattgacttctcccaaagatgtaaaagaaggatataaactaggtgttaataactatgtgaaaaagccctttgtgcccgatgaactcgatgcgcatatacatgccattcttaaaataaaagcaggaaccaaatcacgcaatgaaaatgaacattataaactgggacgtttcacactggatgccaaacatgccacactgtataatgatgaaactgaagaaaaaaagatgctaactgtacgcgaggcaaaaatacttcaactcttctgtaagaatataaatgaaactgtggaaagaaaagctattctaagccgtttttgggatacggaagacgattattttaaatcacgcagcctggatgtttttatcacgaaattgcggaaactgttgaaagatgaacctcgcattgaattgaaaaatatccgaggagtaggttatacattgttactgacctgaaaaagtaagatatgttcatgagcaaagtaagttaacttacttgcccctcgaagttaacttacttttttcacttaatatgaaaccgaaaccggaatacctgcctctttcaccaatcctcctattttatccaattccttatgagtagctttttccaaatcatgatcgggcgtttcgcggtcaatggtataaatcatcacttgacgcggagctatctttttcacaacctccaaccaaggtaacacataccggtctgtcgtattattcacatcctgaccttgataggtacctttcatgaacatagtctgaataatcagctttcctttgaaagctttcatgccttctataattttctgcacatcataatgtccagtaggacgatccgtcaaatggatataatccgtatcaatggtatccagtttcaatatattattatctatcttattcaatgcatcaaatacctccggtttgtgaataaaagtagagttactcaatacactcacttttgcctggggaaaatatttatcacgcagtgccaaagtatcctctataattcctgcgaagtgaggatgagccgtcggttcgccattaccggcaaaagtcagcacatccggtttaggaccattttgctgcatatcaatcaaacgggcctccaaagcttcacgaacctgctcgcgagtaggcagtttctttttcggacgatgatcttcattaaaaccacattcacaataaatgcagtcgaaggtacaaaacttgccatcttcaggaagaagattgattcctaaagaaactcccaaacgacgactatgtaccggaccgaagatgggagaaggataaatgattgttgacatagtttttttttcagttgataacagtacaaaaatacagaatgtttttcagaatttcagcctcaactgcaaataaaggtcactctttgtactgccgtcaatttcctccaaggcggaacttatcttatcccgattgaaataatgagtagttccgtacttggcctgcaagataatgtgtttattcaattcataacgggcgttcactgccacacgcatacctttataatagaatgaaggcatggaaaaagcatagagcacactcttttcatagatagtaagacgggaattatagtcatctgtgttaaaccatgcggcactcaaatcaagctgaagaggaagcaaatggaaggtataagcagcactttgagaaaccagaaaaccattggaagcagattgcccacgaaagttgatgcgtacataatccgctatggttttcaatgtcagcttatctttcacgctataattcaattggtatcggcatttctgctgaatagatggaatagtttgcttggttttatcctcagcagtgaagtccttttccttctttttataacgatatcttataaacatttccagttcataagtaggtgaataacttaattggagtaatccgtccaatcctttggttcctgctttgcttactaaatatttcttccaagggaaatagaaaaaatcaccataacaagtcattttgatatactttaaaatactggtttccaatcctatataaaatccactctcattttgtaccgtacttccctctcctatagaacgagcataaaccgattgatatttggcatcataatacctgttcataactattaactgtgttcctcctttcggtgaataacgtaacatattcatggttgcccaagtaccacatttgtctatagccgtttcacccaataaagagaagcgtttccaaaagaatttataatctcctcccacattataaaagtcctttccacggggataataaatattatagtacttcttctcaggattcaacggcttgttgaaaacattataaacagctgttaatcctaactcacagtactttccattataatttaaattactgccaaccaactgattagttaatgtatttttcttctcaaactcacgatacaaccgatgatatccatcttttttcaacgaccttataaactggttatcaacaataccatccatcttccgataagaatagaaaccatccaatgtccatcttttcgccaacttatagctgactgccattccttgaaaatagttatattcatcggtagaagagtgcttgcgtattccccggctcttatttcccaaagtagagagtgtagctgtttttcccatcccgaaatcagtgttgataactagtccataaccatagctgacacggtaattaccaagagctaaagtcttgatatgacctatattacgaattaacaagtatagtgaataaaaatcataaccttttttattttgtccggtaaagaaaggttctcctgcatccttttcagcagtaattcctgcataaatctgatcccgataatgaaaactatatcgcagattatgataatatccatatcccaaatactgtttgttcggattcttttttaaagtttctgccgggtactgttgatacccggccttcgtataaaaaggaatatcaacacgtgttgataactcttgtttaccgtatttcaatatccgctttatatttggtttatattgctctttttcaggagtttcaaagtaaataaagggtagtaaatagtgaatagtctgcctgtcaatatcttcaatcatccataactcattgcgggtaagcataggaccatatttgtacagataatacaatatattctctaccagttggtcagagagaaatggaaaacgttccagttgctctttagttgctgtattgatattgatgggattttcacgtaattcggaaagctcctcaaagtgagtatcccattgaaacgaactgttttcatcttcatccatcaattgctctaccagttcttcccatacttcctgcgcacacaggttatgcaccgacaaaagtattgtaatacagataattaacattactttcaacaacctgttcattttgtaattcattggcgtgttttaagttaaatagttttatccactatacagagtaatcatatttcttgctacttttgcaccaagatgaaaaggaaactctttatagcattgtttttttcctttatagccgttgctgctcattcccagcaacaaacgactactataaacggatacatggtacctgtatgtgtatacaaaggagatactattccagctgtacagttacctaatgtatacattttcagaccattaaaattcaaaaacgaaaaagaaagacgggaatactaccgcttggtaaggaatgtgaagaaaaccctgccattagcccgtgaaattaaccgtgctgtaatagaaacttacgaatatatagaaacattgcctgacaaaaaagccagggaaaagcacctgaaactcgtagagaagggattaaaagagcaatatacaccgattatgaagaaattaaccttttcacagggcaaactgttgataaagttagtaaaccgtcagacggattcttcctcttatgaattggtaaaagcttttatgggaccctttaaagccggattctatcaaacttttgcagcactttttggtgccagcctgaagaaagaatatcatccggaaggagaggatcgactgaccgaacgggtggtattgttagttgaaaacggacaaatctaactgattcctactgtttgaattttactcttattatctgaatttcattaatttattggcaaactcccatacaataatccctgtcgttactgatacatttaacgaatgttttgtaccatactggggaatctcgatgcatccgtcacaggcattgactacttcctgttgtacccctttcacttcatttcccattacgatggcatatttcttatcggcatccagttccagtttatccagcaaagtactgccttccacctgttcgatagccaatacggtaaacccttgatcatgaagttcctgaacggcatcaagcgtattctttttatatctccactccaccgaattctcagctcctaaagctgttttatgcatttcgggatggggaggagtggctgtaataccacataaataaatgcaatctaccaaaaatgcatccgatgtgcgaaacactgatcctatgttgtgtaaactgcgtacttcatccagcaccactgctaaaggcaacttatcggctttcttgaattcgtctacagtaagccggttcagttctgttattttgagtttcctcatactctattttctactttattattaacggttacaaacttacataaaaatctatgatctttacgcctatataatgaaaaaaaagtctcccctactctctttttatttttacttcagtcccaaatccatctgttttacaattggatttctttatacaaaaaaagataataactaattcacatccccctgttgataacggttgaaaacatgtaaaaaggatgaggatatcatttcaaaagtatttcttgcatatttcaaataatggtataacatacacttaaaatcaacaatccaaaaattaatcacataacttaaacaatcaatatcaacacaatttaatcactattataggcattcataaccataaagtttttaactttgcatattatcaacagtttgttaatagaacaagtaaagacagtataatcagtgcttaagccagttgattacttattcatatctcactattacaaatgaataacttatcaggcaaggaaaagagtactatttttactaacaatatgaacagactattatcaataccatatttctttttttgaaagaagaagaaaaaatatagatataatgaataaagaagaatggttgaaaaaagggtatgttaccgaaccggtagacaaaactctggatttgaagactgaaattgataagttgcgtaaggaaaagaatgtgcttatcctaggtcactattaccagtcgggcgaaatacaagatatcgccgactttgtaggtgacagcttggcgctggcacaatgggcggctaaaacggatgctgatatcattgtgatgtgtggtgttcactttatgggtgaaacggctaagattctttgtcctgataaaaaagtgctggtaccggacttgaatgcaggatgttcattggctgacagttgtcctgctgatgagtttgctaagtttgttaaagagcacccggaccatacagtgatttcgtatgttaacactacagcggctgttaaagcggtgactgatgtggtggtcacttctaccaatgccaagcaaatcgtagatagttttccggcagatgagaagattattttcggtccggatagaaatctgggtaattatatcaattcgattacaggacgcgatatgttgctttgggatggtgcctgccatgtgcacgaacagttttctgtggagaagatactggaattgaaaaaacagtatcctaacgctgccattctggttcatcccgaatgtaaaggagccgtttccaaactagccgataaggttgcttctacggcaggacttttaaaatatgccattactagcgacaagaaagattttattgttgctacggaaagcggtattctgcacgaaatgcgtaagaaatgtcctgaaaaaaactttattcccgctcctcccgaagacagtacctgcgcttgcaatgaatgtaattttatgcggttgaatacgatggaaaagttgtacaatacattaaaatatgaatggccggaagtggcagtggatgaagcaatagctgaggaggcggtgaaacctatcaagaagatgctggaaatttcggagaagctgggattatgacttttgtaaaagataacaagatatggttgataaaagacgtttctgttgttcctaaaagtaaaagggaattcttctggaaaagatttatgataggatgtatcatcggaataggagtgacattgctggttctgttttattaaagacttgttttgacgggataatggttctcatggaaatcattattccgtcaaaattgttttcaaaggaaaacaaaatacttatttttatgagagtcgatggaagtaaacaaatgatataactaattttatacagttttacttttttacgccttcagaaatcggcaaagcttctctacggccagcgcacggtggctgattttgtttttcgtctcattgcctagttcggcaaaagttttagtatatccttcgggcacaaagatggggtcgtacccgaaacctgacgaacctcgtttttctttgataatctcaccttttacaattccttcgaacaaatgcttctttccatccagaattaggcagatagctgtacggaactgtgcctttctgttgggggctccctgcatattctgcaataatttttgcatattggcttccgcattgtgtccttcacctccggcataacgggcggaataaacacccggcgcaccattcaaagcttccacctccaggcccgtatcatcggcaaagcagtccagaccatagttttcaaaaatatattccgctttcagcatcgcattaccttccagtgtatcggctgtttcggggatatcagcatggcagttaatatctttaaggcttaataattccaccttttcacccaagatagcagagatttcctccaatttatgggcattgtttgtagcaaatactaatttccttttcattttatattgtatttattgaatgcaaagatactgagaatgaaccaaagtaagataattcctgacagaataatataggtgaaaaggtaaataataatttgtttgctatgtttattttcaatttttgattatcttcgttggtatcatttgatacttgatagtatggtatatatagaaacgcctcatttgttgttacgggactggaaggaggaagatattcttccgtttgtccgcatgaacagtgataaagaagtaatggaattctttatcactactttgacacaggaagagacgatggctttttattgtcgtatccggaaagaatttgaagaatatggttatggtttgtatgctgtagaatgtaaaaaaactcggaattttctaggctatgtaggttttcataatattgctttcgaatcggatttcactcccggagtggaaataggatggcggttgtgccgggatgtatggggaaagggatatgccacagaagccgcctctgcctgtctggattatgcgagtgataatttaccttttaaaacggtatattcattcactgccatacccaataaacgttctgcacgggtcatgcagaaaataggaatgcattttgaaaaagagttcgatcatcctttggtggaacaagagcattggctatgcagacatgtattgtataaaatagaaatttgagagaataggataaccgatatgtggtaatcttatcattgcttcatcgttctgtttttcaatgcagaaacagaacgatgaagcaatggtaagagattattttttagttactttatttttagtttgtcgaacccttctccatacactcctaccacattactttgtgatataaatgcattggggtcaatatctttcaccaatcggaatatatccagtgactggctttttttggctaataccactacgactttgattccttgtttgctataccatcctgtaccatctaatagggtaactccacggtctatttgtttggtgattccttcggctatttcatcatgtttgcgcgagaaaataaggaactgtacagattggcgtgaactgtttattacataatcaatcacaatgctcatgataaacaatacgcagaaaccaaacaacactcgtttccaatcatggaatatgaaataacaggaggatatgatgacaatatcacaatacatcatcatgcggccaagggttacatctttgtatttattgataatccaagcaatgatatccgtaccaccggtacttccattattgcagaaaacaatgccgataccaaatcccagtaagccggcacctactacacaagccatgaattcttgtcctggtcctaataattgcggtagtgttccatccggacctttcaacaatgtttgaaagagccataacagaaatgtcagcataaagatggcataaatggtcttcagactgaatttaggtcctaatattttcaatgcgaatcctagaaaaacagcattgatgatgaaataagacacttgaatctctattcccgtagcataataaataattgccgcgataccggttactccgcctgtagttatttgataaggcagtaagaaagccgcccatcccagtgcatagcaaatcagtccgaaggtaatggctaaatagtcttttacctctctgcctagtttgatttttaatatttggtccatggtaatgaggattgtttttaatataaagtagaaaggtgtgtcaaaagttactgcttttgacacacctcaagtatagtatcgattataatacgatatttacaattttcttcggaacgatgattacctttttcggggttttgccttcaatccatttctgggcttgttcatttgccataactgttgcctgaatggtattgttatcggcatcagtagcgaactccatggtgaagcgtgctttaccattgaaagagatagtgtattttacagtgtcttcttttaggtaatcttcattgaatgcaggccattgtgcatcgcatacgctggtggtatttcccaaagcttcccaaagttcttctgcataatgtggagcgaacggggctaacaggatgatgagattgctcaatacctctttattgcggcatttcaatgaagtcagttcgtttacacaaatcataaatgcactgatagaagtgttgtaagagaaagtttcaatatctccggttacctttttaatcagcttatgaattgctttcaactcttctttagtcggttcactttctacaggcaagaattcgtctgtgcggctataaaacagattccacagttttttcaagaaacggtgaacaccatcgataccattagtatcccaaggcttggactgttctaccggaccgaggaacatttcgtacatacgcagcgtatcggcaccgtatttttcgacaatcatatccggattgactacgttgtacatggatttactcattttctctactgcccaaccacagatatattttccatcttctaggataaactcagcgttgttatattcaggacgccatgctttgaaggcttcggtatccagaatatcattggatacaatattcacatccacatgcaatggagtggtttcgtactggtctttcaggttcagtgacacaaatgtattggtatctttgatacgatatacaaaattgcttcgtccctgaatcattccttgatttaccaatttctggaatggttcttccttgatgcttacgcctaggtcatgcaggaacttattccaaaaacgagaataaatcaaatggccggtagcatgttctgtaccacctacatagaggtctacattctgccagtagtgatctgccttttctgataccagtgcttggttgttatgtgggtccatatagcgcagatagtatgcggatgaaccggcaaagcccggcatggtattcagttcaagtgggaatacatggacatggtcaattaacgtattttccactacttcgcctttttctacatcccaagcccacttggtggcatgtcccaatggaggttcgcctgtttcagtcggcaggaatttagccacttcgggaagttcaagtggcaatttagaggaatcaatcatataaggcataccatctttgtaatatacggggaacggttcgccccaataacgctggcgtgagaagatggcgtcacgaagacgatagttcactttcacacgtcccaggttgtgggctttcacatattctttggtagctgcgatagcttctttgatggtcagtccgttcaaagaaaggtcacagtaaggagtgacatccttgcggggtgagttgcaaacaataccttctttggcatcgaaactttcttcacttacatcacaaccttctaccaacggaacgataggcaggttgaaatgctttgcaaaagcgtagtcacggctgtcgtgagcaggaaccgccatgatagcacctgtaccataacctgccaatacataatcgctgatccatacgggaacagcatcgccggtaaacggattgacagcgtatgagccactaaatacaccggtcacacggcggtcggcgatacgttcacgttctgtacgtttcttggtacggtctagataggcttctacttctgctttctgtgcttcggtggtaagttggggaaccagttcactttccggagccaataccatgaaggttacgccgaacatggtatctgcacgggtagtaaagatggtgaattcaatatcgctgtctttcactttgaattgtacttccgtaccttccgagcgtccgatccagttacgttgtgtttccttcagtgaatcagtccagtccacggtgtctagcccgttcagcagccgctgtgcataagctgaaacacgtaaacaccactgacgcatctttttctgtaccacagggaaacctccacgttctgaaactccgtctactacttcatcattggcaagaacagttcccaattgcggacaccagttcaccattgtttcgcccagataagcgatacggtagttcatcaggatttcctgtttttctttttcgcttttggcattccattcttcagcggtgaaatgtagttcttcgctacaagcggcgtttaattcttcgttgccatatttagaaaatgcttccgccagttcgctgatgggacgtgcctgctgtttgtcattgcaataatagctattgaacatctgctggaaagcccattgagtccaatggtaataaccgggctcacaagtacgtacttcacggtcccaatcaaaagagaaaccgattttatccaactgttcacggtagcggttgatattgttcacagtggtgatggcagggtgttgtccggtctggatagcatattgttctgcaggaagtccgtatgcgtcatatcccatcgggttcagcacgttgaaaccttgcaaacgtttataacgggcataaatatcactagcaatgtatcctagcgggtgtcctacgtgtaagcctgctcccgatggataggggaacatgtttaatacgtagaatttctttttgctttcgtcttcggttacttgataggtatggttctctacccatctttgttgccatttcttttcaatctctctgaaattgtattccatgatctatttttgttatttaatatctttgttattaagtggttgcaaagataatgaaagtcgtggagatatatggaaagaacagaaaataaaaaacttttttatcatgtatatatatttgtttttatttacatttttgggagtagtacatattaggtatacaccttacaaaatttattgtatttatttatacaaatagcagttgtaagatatacgatgataagattgtaagatttataatctttcgaggataagattatagaacttacaagtatattatttagatatttaaggtataggtgtattatttttcctgtttcaatacgaattccttgctaaaatcatctaccaaacaattaatttccataactttgtttccatcaatacatctaatagctatgaagtactttttcctcttcttacttttatttttaggtaaatactctgtttgtgcgcagcatatgatatctaagcagcttccttttttctatcaactttcgtccaatgagatttttgatatctatcaggataaagaaggatatttgtggataggaaccactaatgggctggcacggtatgatggttttcgtttgcagcctttccgggctgattataagaacctgaatttgctcactaataactcaatttcaaatataatggataatgatcactatgtgtggatcggtacgtggaaaggattaaatctttatgataaacaaacctgtaaaataactccttttccggatgcgagattgttggataaggggattaattatatggcagcagataaagaagacaatatttggataggagccggtaatacaatatacagatgtaattctacggcttctattgtgaaggaatatgatattttcggctcacaacagaataggcatgccattaattttgtttatcaggatagagagggaaatatgtgggcgcttacgggaggaggcttgttcagatatgatgaaaaggcagattcttttgttacttatcctccattaggcaagaataatgcaccttatactatgtgtcaagaccaatcgggcaattattggattggtacgtggggtgaaggactatggcagttctttccaaagaaagaaggggaagaatgttataaaagacatcatattatcaattccagaagtggggaaacggaaccgatcttttatagtatgacgcaagataatacattcggctacttgtggctattgtcttataatgaactttacgccttgcaatataccgaagagggtacattggtacctgtggatatacatgatttggtagatacacacatgatgtacactaaaatcatgaaagacagagaagggaatctgtggctggggtcttatgatatggcatatactattttctttgataattcgaagattgataattatcctttgccgcaacttaaaaaacacatgggttgggatgcgaatatcttgaatctttgcttggataaaaatgatgtaatgtgggtcaatcaggatagatacgggctttgcctgtatgatttgtcacaagatctatttgcagataatagtggtaataatttgtcaaatccgggcgaagtaagcattattgtgaaatccaagcttaaggaaggagtatggatcagtcccagatatggtgcacgggtaatgagaatgactcatcagggtatgaagatacagttggaagaggatattgatttggaaaaacaaatctataatccgggaaatatcagggacttggttgaagataataaaggtagtttatggatttttagccagtcggggctttatgtaaagcgtcctgataattctattttacttgcagcaagttctgattttccagagatgtcttccttgacaagtgatagggaaggtaacatatggggagtgtctactgataaaaaggtgtacaggttaagctgtattgataggaatatatcttatgaattaaaagcttgtattccagttctttcaggacaggaaaatgtaaatcatgcctgtatagatagggagggttgcttatggttggtttcttctttagggagaatattcaaatcggatacgaataaagaggcatttgaaaatatggctttggataatcagatagatgattgctctgtgttggggttgcttgctgatgaaaacaatgtgtggattataactaacaaaaaggtgcttcaatataatatttatcagaaggtatgtatgaattatgccacttcggatgggaatatatgggttgatgtattcaggtatagagcgataagcagggacagacaaggagggctatatgtaggtgggcatcgtggttttatacatattcagtctggtagtgtctcattggcggataagatacagttttctcctgtcgttacggatgtaaaaattgaaaataaaagtatattctttgctgaagatgaatcacttcataccatcaaccggatttctttggcccccaattccagaaatatagaaatatttttttcatcgcttatctattcattgaattccaaggtagagatggcttataaattggatggagtagataaggattgggtatatctgtcctatgataagaattctgctttttataatcagttaaagaaaggtacttattcattctggttaaaatggaaatatggacaaggaaaatggacggaaggcaaagttgtattggctattgtccaggctccggctttttatgaaacttggttggcatatatggtttactttgttttgattgtacttgctgtctatctgtcttttcatacttatgcgcagcgtattaaaatcaaaaatgaagtgaaactaaaagaagagctggcacggacaaaattgaactattttacaaatatctctcatgaattactaactccgctgacagtcatttcttgtgttactgaccatttggaacaaaaagttcctgctatccgacaacagtctgtaatactgaaatccaatgccgacaaactgaaacggttaatacagcagattttggactttagaaagatggatgtgggaaaaatgaatctgaatgtgtccgaaggaaatatcagtgagtttatacagaatatttgcaagacgaattttcttcctcttgctcaaaagaaaggcataattttagagattgacgtagaaccattggaaattaaaggttatctggattttgataagttagacaaaataatatataacctgttatcgaatgccgtaaaatacactcccgaatataaatgtatcaaagtaaacgtataccttatgaataaggaaggaaataaggtcttggttatcaaaataaaggatgagggaataggtatctcatccaaagaaatcaattatatttttactcgtttttatagtagtaagaaacaggtgggaatcgaatcgaatggtatcgggctttctttgacgaaagagttggtgaatcttcatcatggaactatcacagtagacagtgaattaggtaaaggaacctgttttacggtagaacttcccattgacagaacggggtataagcatgatgaaatagtggatgagatggaaggtgtggcaatggatatcaccgaatgtgcaattgtagcagaagatgacgtttcatccgatggagctacggataaatctacccttctgttgatagatgataatgcagaattactctatatcatgaaagagatgtttaaggaaaagtatagtgtatggactgcggcagacggacagcaagcttgggataaattaagcaatcatgaagtggatatgattatttgtgatgtgatgttgcctgatatcaatggttgggagctttgcactcgtattaagtcggatttgcgttttaatcatattccggtggtcatacttactgcgaagaacggcattgatgaccggatagccagttatgatgccggagcggatggttatattgcaaagccatttgaaatgaaagtactttttgcccgtgtggataatcttatcagatcgtttaagatgcgtcaggcggcttttcgtaaagaagaagacgtcaatttggaaactttagcttatccgtctgccgacaagttgtttctgcagtctataattgaaagcatagaacaacatctggaagagtctgaatttgatttggaaagactttccgaagaaatgaacatgtccaaatctactttataccgtaaaataaaatctatgaccggattgacacctttggactttgtacgcaatataaagatgaagcgtgcctgtatgatgttgcttgcgcgtactcagaccatatctgaagtggcatacgctgtaggtttcagtaatcctaagtattttacgaaatgttttaaagaggaatttggcgtgacgcctaccgagtatcagcagtcacatatcaaggcctgataaaagaaagaggggataaatttctgtcattagggtattgaaacgtttcatgaaaggattttataccttctgtaaagggtttcaataccctatttttccaggatatggcttcttttgtttcatgattcttaaataataaagcatgaagaaaaagaagttaccattagtctgttgggatagtatcaaattactaactgtacttttcctgttatggggagtttgtttcggagcagatgcgtatccgggaagtgaatatcgaaaacaactttttgattatgattggaaattcaagttgggggattatcctgacgcttcattgaatacatacgatgatgctgattggaggatacttgatttacctcatgactggagtatagaaggaacccttgatccggaaaatccgatggggaatgatggaggttattttccggcagggacgggatggtatcgtaagtcatttgaaataccttctaagcataaaggcaagaaagtgggtatttactttgaaggagtttatatgaattcagaggtctttattaatggaaaatccgtaggaatccgtccttatggatattcatccttttattatgatctgactccttatctacgttatgatgataagaatattattgctgtacgagtggataattcgcagcagaaaaattgtcgctggtacaccggtacaggtatctatcggcatgtgtggctgacagcgatgaatgctgttcatatagagcattgggggatagctataactactcctgaggtaagtgaggagagagctgttgtacaaataaaaactattttgagaaatgaaacttcttctgacagacagattaccttgacaacaaagttgactaaaggaaatgatgaagccggaaaaggagaaataaaagtggatttgcctgccaatggaataaaggaaataacacaaaaaatttttgtgttgtatcctgctttgtggagtcctgagacccctcatttatataatgcacactttctagtgactgaagcgagtgatgtaatagatagtacaacggaatcttttggtattcggacggttacttattcggctgaacaaggattattcttgaatggcaagagaattattttaaatggtggatgtttacatcatgacaacggttgtctgggggcagcggcttatgatcgtgccgaagaacggaaagtagaattaatgaaggctgcgggatttaatgcggtacgtacttcgcataatattccttcagaagagttcctccatgcctgtgatcgtctcggattattggttatagatgaaacctttgacggttggcgtgacagtaagaatcaatatgactattctattctttttgatcaatggtggcaacgggatatcgaatccatggttcttcgtgaccgcaatcatccttctattttttgttggagtattggcaatgaagtaattgagcgtaaaaaattggaagtggtcactacagctcggaagttggccgactatgtacataagtttgatcccagtcgtccggtaacttctgctttagctgcttgggataatgactgggaaatatatgatccattggctgccgtacatgaaatagtgggctataattatttgctgcatcgagcgccggttgatcatcagcgtgtaccttcccgtgtcattatgcaaaccgaatcttatccacgagatgcttttgccaattggtcgttggtaaatggtcatgattatattattggtgattttgtttggacggctattgattatttaggtgaatcgggtatcgggcgattttattatgcaggtgagtcggaaggtgaacactatcaacgtaaccattatccttggcatggggcctattgtggagatattgatttgacaggttggaggaaacctatatcacattatcgtgacttgttgtataatcctgataagaaactttacttggctgtaaaagagccggataattattatggtaaggtgaaggaaaccttatggtctgtctggcctacttgggaaagctggaattggccgggacatgaaggaaaagaaatagaggtggagatttattcccgatattccaaagtacgtctgtatttgaatgataagctgataggcgagaaattcacagggaaggaacagcaattcaaagcagtctttcctgtttcatacgagccaggaatattgaaggcggtaggtgtggaatccgagatagaaatagagaaaacgatcttacagactgccggaaaacctgtgaaaattcaattaacggccgatcgtacaaaaataaaggcaaatggtcaggatttgagttttatcacagtagaaataatagataaggaaggcattctggagccgaatgctgataatcaattaacttttgaagtgaaaggggcaggtactatagtggctgtgggaaatgctgatttgaaagacacggatagctatatcggttatcagcggaaagcatggaaagggcgtgctatagtggtagtaaaaagtacacggaaagaaggtaagataatgttgaaagtgacttctcccggattggttccggctactgtatccattcgtacaagtaaataataataacctttgtttaattctaaatataatagtatgaaaacatttcgttttgttttattgctgtttttggtattgagtatatccaatacagcttgggcgcaaaaccagactgtaaaaggtagggtgatggactctaaattaaaagaacctcttatgggggtttctattttggaaataggtacttcaaatggtactgtaactgatttggatggtaactttacgctttctgttcctaaaggagttgtattgcgtatttcttatgtgggatatttagttcaggaagttccgataaatggaaaaacatatctggatatatttttgaaggaagatactgaattattagatgaggtggtgattgtggggtatggggcccaaaagaaagctacattatccggctctgtaacgagtgtaggtggtgagaagctggcaaaaactccagtgacgaatgtatcacaaggattagccggacgtttaccgggcgtggtcgctgtttccaacacttcagaaccaggatatgatggtgctactattactgttcgtggggttaatacctttggaaaagctgatccgttagtagttgttgatggagtacccggacgttctttggagcgtattgatccaagtactattgaaacgatgtctgtattaaaagatgcttcagcagctatttatggtgctcaagctgccaatggagttattttgattacaacaaaacgaggaaaagcaggcaagccgagagtaggttttacttataattatggaatagctgctcctactgtaataccggaaatgaccaatgctgtggaatatgctactttgatgaatgaaatagataagtatgccggtaataagggccgctatacggtagatgatcttagattatatgctgatggttccgatccttggggacatccggatacggactggtttaatgaaacattgaaatcatggtctccacaaacttatgccaatgctactattgatggtggtacagagaatgtgaaatattttgttagcgtatcagccaaaggacaagatgcattttatcgtcatagtgggtcaaattaccatcagtatgacttgaagatgaatcttgatatgaaaattaataaatatgttgatacttatgtcaatgtaacaggaagaatggaagatcggaaatatccaacccgttctgcagagaatattttccgtatgctgatgcgatctaaacctaattcaccggcttattggcctgacggccgtccgggacccgacattgaatttggtgataatccggtagttatatgtaccaatcaaactggttatgaacgtgataagcgttatgtgttaaatggggatttcggagttaatatcaaggtgccttatgtggagggattgactttgaaggctactgcgtcacttgataagacgttccgttttcgtaaaatatggcaaaaaccttggtatttgtattcatgggatgggacttcgatggatgaaaatggccagcccctattggtggaaggaaagaaagggtttagtgatcctcgtctgacagaatcaatggaagataatttgggggtattattgagtggtatcgctagttatagccatacatttgctcaagatcatgatgtaaatattctagcaggtgtagaacgtatcacggataagggggattcatttgaagcttatcgtcgttattttctttctgccgctattgaccagctttttgctggtggtcaggatgaaatgaataatacaggtacagggtatgaggaagcccgtttaaattattttggtcgtgtgaactatgcttataagtctaaatatttggcagagtttgtttggcgttatcaaggttcctatatttttgatcgttctaataaattcggattctttccaggtatttcattaggatatgtaatatctgaagaagattttttcaaaaagaaattgccctttattagttttgccaaagtacgggcatcatggggacagacaggaaatgatttgattgatccttatcagtatttggcttcctatactttcaatgatttgatgtatttgactaataatggtacaacgatgaaccaagcattgaaagaaggagtagctcctaatcaaaatgtgacttgggaaacagctacacaaaagaatataggtcttgatttacaatttttgaatggagatttggcatttactattgactattttcataataaacgcagtgatattttatggaaacgaaatgcttctgttccgggcacttccggattggtacttcctgatgaaaacttagggaaagtacaaaatcaaggggtagatttcaatattgattatcgtagaaatttcaaagattttcggttgggtataaacttgaatggggtttatgctaaaaataaaattcttttttgggatgaggcacctggtactccagaatggcagaagtccacaggcaaacctatcgattcgggactttattatgaagctatcggcatatttaaagatcaggtagctgtagatgcgtatcctcattgggccggtgcacgtccgggggatattattttcaaagatgtaaatggggacaatgtgatagatggcaatgatcgtgttcgtaatgataagagtcgtactccacgatttacaggtggattgaatgtagatttaggatataaggattttgacctttcatttttactacaaggtgctatgggaggagttttttatcaaacgacagagtcgggggattttgccaatttcttaaaaagtttttatgataatcgttggacagaggaaaacccagatgccgattttcctcgtacttataatcgaagtaatgaatattttataaatcagcagaatacattctggttgcataaaactgattatatacgtttgaagaatatagaattgggatatactgtaccatctatatggagtaagaaaataggtgtggaacatttacgtgtttatattaatgcttataacctgctgacaattagtcctgatatgaaggattatgatcccgaaaacacaagcggatcgggatataattatccgttgaataaagtgataaattttggagtaaaccttactttttaaataaaatgaaaaatatgaaacgtttatatggattatttgtattgctatgtcttatgctaacagcatgcaatgatgattttttggatgtggatccagtagaccgttattcagatgcagttgtctggacggatgaatcattaataacttcttttgttaataatatttacgagggacagaaatggggatttcataccgtaatgctttcttctttgtgcgatgagtcaatggaggtttgggcatgggagagccagccagtagtgatgagtgaattgagtcctagttatcaaggtattcttgctcctaatttttggattataaccttccataatataacttggaccaatctttataaaaatatccgtgcctgtaatatcttttttgaaaatgcagagaaatatgctttagaaggagatgttgtcgataaattgaaaggtgaagtgcattatttacgtgcttatttttattattggttgttgagccaatggggtggtgtccctttgattgagaaatcttttactccttctgatgatttactcgtagctcgtaatacgtttgaagaaacggtagattttattgtgaaagatttagatgaagcagcttctattttgcctttgaacggagataaagcccgtgcaacaaaaggtgctgctatggctttgaaagcccgtgtcctgctttatgcggctagtgacttatttgtttctcagtctttatgggcatccggttatgagcatcctgaacttatagggtatgtgggaggtgatcgtacggaacgttggcaacgggccaaaaaggctgctaaagctgttatggatttaggtatatatcatctgtatggtgaaaatggaggatggaaaaatagagaggaagctactcaaaactatgctgatattttcttatgtcataattcggatgaagatattatggtacaatattatgattatgtaaatcataatagcagtgattttcaattgcctcgtgttggtttgttcaatagtcccaatggttttcatggttggggcggaaatactcctactggacaattagttgattcttatgaaatggcagatggcagcaaatttagttgggataatccacaacaagcagcttacccttatcaaaatcgagatcctcgcttctatgcttctattatgtataatggttcttattggcgtcaacgtccggatgatacagtaggtagtgatcctgaaggaatagtacaaactgcttattatcagcagtcagatggaagttatacaccaggtttagacactcgccaaggccctattgaagattggaatggttcttatacaggatattatatgcgtaagtttttagatccttcagttaatcatcagtatgataaacaaccttatccttggcgtcagatacgttatgctgaagttttgttgaattatgctgaagcatgcatagaattaggtgaagatgctgaagcccgtaagtatatcaatatgattcgtacaagagcgggaatgcctgacataccagattctgaaatgggagatgtcttgaaagaacattatcgtaatgaacgtaaaatagaattagcttatgaacaacatcgttattttgatatccgccgttggatgattgcacctgaagtgattaagaatgttcaaggaatagatattcgctatccttatggagttacagagcctaattattccattattgatgtgcaggagaggaaatggaatgataagtcttatttactccctatttatttggatgaaatgcagaaaaatgatttattgatacaaaatccattatattaaaaaatcatagataagcccgtagcttaatgatggctacgggctttattaaaaagaatgattttttattccactcccaaatccttataagttctcggagccggaacgggaggtaatggtttgcgatcctttaactcttgtagaattacctcaatggctttattcaactgctggtcttcacctaactgttcttttaccgggtcattatcaatcagaatatcgggatctactccatggttctccactatccattgaccggtctttgcatcataattggtaaagaacggaacacgtacatccgtaccatccatataaggcaacgggccactgataccgataatgccaccccatgtacgagtaccgataactttaccgattttatttgccttaaaactccatgggaacaagtcaccgtccgaagccgagtatttattgattagcaatactttcggacccactagtgttgcatcaggaatggtaccgattttggttgatccacgacgcatggtcaggcgatagggttcacgaagcaaacgttcgataatcattggagatacattaccacctccattggcacggtcatcaataatcaaggcttctttatcgagttggggatagaagtagcgggcgaattcattcagaccgtccggtcccatatcgggaatatagacgtaacctacacgaccattagttgcttcttccacttttttgatattattctgtacccagttataatgatacaatgggtattcattgtctaatggtttaatgaccactttacgtactcctttacttgatgcggtacggtttatgcttagttcagtcaatacattggctttgcctgccagcagactgtaaatgttatcaacagtagctgttgagatgccatcaatagctgtgatataatctccttcttttactccgatacccggttctgtaaggggagaacgcagtttctgactgtaaattgcacccggtaggattttgtcaatacggtagaagccactcttgtcacgactcagttcagctcccagtaatcccattggaatacgttcgggaccttttatttcacccggattcacataagcgtgtccgcaagccagctcggcaatcatctcaccgatgatatagttcaagtccagacgggtttttgcatgaggaactaatacagcatatttttctttaatcgcattccagtctactccatgcatattttccagatagaatccgtcacggaaagcccgccatgtttcatcgaatatctgagcccattcttgactgtaatcaatgggagcaaccatatcgcttaagttaatattctcttccaatgaggctttagtgcatggaaaatcacagatatacagattatttcctttaaagaacaatgctttcttatgattggcagctacatccatatatgctccttcggctacgatttcttctttttgtttagccaaatcatatactttggtacttctaccactggcataccacacttttttaccgtctgaatagaaattatcgtagttacctgcttgtaaaggtaatttaatcagtcttccgggcaagccttccggatctattttaactgtattatttgtggcttccggttttttattggccgcatcggtagtctgttgttctatgctgaccatttcatccgaaggtaataaaggtgacggtgtgtcattggcgagcatggccatatagactcctcccatacgattataggcatgattccattctgtctggctgtagatgggattaaaatctctttcggaactgaatatgaggtattttccatccgtgctgaagacaggtgaagaagaactgtaccatttttcggtcaccggatattccttacctgaagtcagatggtatacataaatgacactcatgttattagctccggatttagtataggtaatccattggctgtctggtgaatagttcacttcatagaactctccttccggattctgcatgacagtccgtttcgcttttgaggcaatatcaacttctacgatacggtttttacggtcggtataaagtattttcttgctgtccgggctccacatcagttggcggatataagtatcattgttttgggtcagttggatgggatcacccccttcgacagattgtagccagatttcagtttcaccggtacggtcactgatataggctatttgtttaccgttcggactccattctccttcccgttcattggctcccggggtgcgggtgatatcacgggttacccctttttcggcagggatatcgaatacttctccgcgagcagttactaccagacggtggccatccggtgaaaggctggcggcagtcaggttatctgctacccgtttcatttcttttcgggcatagatattgtctgaagtcagcgtgatggagattttttctgatttgcgcgttttaggatccagtttatagaggtatcctccatgttcatagacaataatttgtccgttactgctggggaattttacatcataatccgtatagttagttactttttcagtttgtttggtccggatattataaacaaagatattcatggtgcgatcccgatcggaaataaagtagatttcctctcctatccacatagggataatatcttgtgcaatattattggtgatattctctactttcttagcagccggatcataaatccaaatgtcatctgccatgccaccgcgataatatttccaattacggaattctcgcataacccggttgtaagccagcttttttccatcgggggaatagctgcaaaaacctccttcgggtaatggaatcacttcgggcattcctccgtttttcgatatgctccatagtttgccatcaaaaccgtcactgatacgattgcggtagactatgttttttccatccggcgtccaagtcattactatgttattgggacccattcgatctcctaagtcatcccggttgtttgttgctgtgtaggtaagtcgttggggttcgcctccgtcagttggaatcagatatacttcagtgttaccgtcatattgaccggtgaaagcaattgattttccatccggagaaaaacgtgcgaacatttcataaccgatatgggaagtcagcttttgtgcttctcctccattcaaaggtgctttgtacagatctccggcgtaagaaaagacaatgtcggagccattggtagcgggaaaacggagtaatctagcctcatcggcatgtccggtgaaagctgttcctgccagtaacagggagaataatagctttttgttcattttatttagggtttgattttcgtcggaaacaaagttaggtattattcttcagattatgagctggaacttatttcttttttcagttgattattactagagttttttaataagaaatagttttattggcatgatgtttttaagaaatgctatatttgcaatattaatagtcttaataaagatggatgcaagtatagtagataaagatttgattgaaagaataaacaaaggagaagaaaaagcttttgaggttttatataatagctattttgtctatctctgtgcttgtgctaattcttatatctttaaccctgtggaagcacaagatatagttaatgaaacttttgctaaaatatggtataggcgtggtgagttatcttttcctattcatgcttatttgatacgtgctattcagaacgggtgtttgaattacctccgttcgcttcacagccgtgaaagaattatagatgaataccgtgaagcattacttgagtatcaagaagaattttgtgcttccgagtgttcgcctttgcaagaaatggaattagctgatttggaaaaatcagtccaaaatatagtgtcttccttgcctgataaatgcaggttcatttttgagcaatatctttattccaatctgactcctcaagagattgcagataaaaataatatttcagtcaatacagtcagagtacatgtaaaaaatgccatggataaaataagagaaaaggtgggatctagagtagggattctattattttttcttttctaaaaaaagaatgaaaaaaatctgtttttggcttaaatgttttgtctgttgcttgtgtattatctatagtagataattccaaagatataaaatgaacagccaaatagatgaatttgaacgaataatgctggattatctgaaaggcgaaatctcgtctgaagatatgcagaaactaactatattactgaaaagagagaatgcttgtcgcgaaaaatatcgtgaaatagcccgttcttatgcattggcatcctcttcttggtttgcacgcaggaaagagcaaaactttgagcaattgtgtgatacattgaatttctattcttctcgtaaacattcttttttccgtaaaataagcgtttggagaagcgttgctatatggactttactgattggttgtagtataacattcttttatttatatcattcgtctagtccagaagttcttactccttcttattgtcagattgaggttccccagggggccagttcgaaattattattgcctgatagtaccattgtttttctgaatgggggaacggttttaaagtatgatgtttctttgcagcagcggactgaccggaaagtttttctttcaggtgaggcttatttcaaagtttctagaaatatgctcaagccttttattgttcatacgggggaattgaatataaaagtattaggtacaacatttaatgtggcttcttatcctgatgatgcggaaataaaagtgagccttgtggaaggtagtgtgaatgtttacactacttcagatgctaaaaagaatattcttctttctcctgatgagcaagctgtttataataaaaatgataaggtgttgtctatgagaaagatagatgcggtatctcaagcagcatggactacaggaagactggtatttgttaatgaaaagttatttgatattttgaaaacaatcgggaaaaaatatgatgtacagatacttgtgcagtctcggaaagtgtatactgaatatttttcaggaagtatagatacgaatctgactttggatgaaattctttcttatttagatgtggataataagtttatgtggagaaagaaaggaaaaacaatagttattacagaccggtaactgatagataaaaagtactgtgaaaagtacatgcttaaataattgttaactaaaaattctaagtatgaaaaaaaacttttgtaaagttcgtagggggcattgcctctctcttgtatggatagtttcatttctactatggggaaatgtcactatggccgcattgcctattcaggaggcaaaactttctatacaacagcgttcagtggctttgagtcgggttttttatgagattgaaaaacagaccggctactctttccttgttcgtaataatgatattaatatgaatgagaaagtatctattgatgttaaaaataaaagtgtggaagaggtgcttgagatgttgtttgtagggaaaaatatccgttataaagtggaaggggagcatatttctgtttataaaccccagcaatcaagacaaaatgcaattaccggattggttatggatgtggcaaaagaaccagttattggtgcttctgttgtggtaatgggatctactaacgggtgtatcacagattttgatggaaaattttctttagaagtttctgaatttcctgtgaagttacaaatcagttatattggttataaatctcaagaggtaactgtacgtgatacaaaaactattcaggtggtattacgtgaggacactgaaactttagatgaagtggtggtagtgggatacggttcgcagaaaaaagcaaacctgacaggagccgttgcctcggtcaagatggatgaagtgataggcaatcgtcctttgtcacaagctgctgatgcattgcaaggtacggttcccggcttgtttgtgtctagtgatggcaatgctccaggtaaaagtaagtcattccagattcgtggcgcttattctgtaggtattaaaaatgatgatggttcttatggtagtgctatcaagcctttgattttgattgacaatgtggaaggagacttggatatggttaatcctgaggatattgaaacggttacagtgttgaaagatgctgcttcagctgccatttatggtgcccgtgctgccggtggtgtaattttggttactaccaaacgtccgaaaggagaaacttctttccaactgaattataataataactttgcctttgcaactgccatgaatttgccagaacaggcaccgttgatggaatatttgcaggcctattctgatgcagccggagatcaattctggacaatgggttcgcctagtgtaagcaaatggatgggatatttggagcaatatcgtaataatccgtcttctattcctactgtcggcgatggtatctttaaagatacggatggggctgtttattatatgaatgaaaaggacttggtgaagaacatgcttgagactagtttccagcatacacataatatatcaatgacaggtggtactgataagctccgttatcgtctttctgccggatttattgataatgacggtgtgctgattactgacaaggataaatacagacgaatgaatgtcagtggatttatatctgccaatgttacaaaatggtttactcaggaagccacttttagctatgcacatagtaaaagaatggagccaaagtctgctttgggcgctgtttacagtactcgtcttgcttctttctatccggaaggcaatatgccggaaggtatttctgctgcaggcgatggattacctttctttactccgtccaatcagatacgttggtccaatccagaaaaaacattgtatgacaatcctcgtattttcctgaagtctatattgaagccattaaagggatttgaaatagcatttgaatatactttcgacaagaatatatatgattatagttggtatacgggaagtgtggtatatactactgtgcaaggtggtaaagacacgactccgaccaatgactatttacaaaaaaagaaaagatataccgactataactcaatcaacttgtatggtacttatgatttctcattgggtaatcatcagtttaaggtaatggcaggtttcaatcaggaatccagttatcaggaaacaatggaggctttatcctatggacaagctgttattgaggtgccttcattgggttcgggtacatctacattgaaagctacggacaagtataatgagttttctgttcgcggcggattcttccgtgtgaattacaactatcaggataaatatttgctggaagtaaatggacgctatgacggttcttctaagtttcctaaagaatcacgttacggtttcttcccctctgtttcggccggttggaacattgcacaggaaaaattcatggaaagtactcagaattggttaggttctttgaagctacgtgcttcttatggtatgattggtaaccagaacgtgcctgcttattcgtttattccaactatggcggtgaataataaatacaatggttggatatccaatggtaattatgtaaccgctattacttctattccttcattggtaagtcgtaactttacttgggaaaaggtagggacattagacatcggtattgatttctctatgttcagtaatcgcttcacaggtacttttgactggtatcagcgtaatacgaacggcatgcttgctccgggtgtgcaattgcctgctgtagtaggtgcggatgctccttatcagaatacggcagatatgcgtacatgtggctgggaactgagtttcaattggcgcgaccagattggaaaggtgagctaccgagtcggtttcaacctgtccgacagcaagtcaaagattgtgaagtatgacagtaactcatcctacatattaagcagccaaaagacgaatgcgctgacgggtggaacatatacattttgggagttttataaaggtaaggaattaggcgaaatctggggatatgaaacagatggttattataccgtagacgattttgtcgatacttcttcatggaaattaaaggatggcgttccaagcatagatggctataatcctcgtccgggtgatgtgaagttcaagaacttaatggatgatgaaagagggacaaatatgatttccagcggtaacaatacgttgaataatccgggcgaccgtaaagtgattggtaatgaaactcctcgttatctttatggtattaatctaggattaaactataaaggttttgatttgagtgcctttttgcaaggaaccggtaaacgcgataaatggattgccaatacattgactttcccattatattctgactttaagtttattcctttatataaaggtttgggtgattactggcaaccggtagatgctgccaatggtgattacacagcagttaatcctaatgctgagttcccacgtatttatggcaactatggtaaccaaggctctaattaccgccagtcagacaagtacttgtccgatgcttcttatctgcgtatcaagaatgttactttgtcatatacattccccaaagcatggattaccaaaatatctttgtcgcagttacgtgcttttgtcagtgtagaaaatctggcaacgttctcatcattgccaaagggtatcgacccggaaacgctgaaatgggattatcccgcattccgcacagtatcctttgggcttaatcttacattataaaccttaaattagtacgagtatatgaaaagattatttataagtttagcaattctcgcaggaatcagcctctctagttgtaatgatagtttcttggaaaagactcctgttacagacttgacggagaataatgcattcaattcctacgataacttcaaggcttttatgtggccttgttatgagatgtttacaaataatactattcgcacttccttacaaggattcggacaagacggacagtataagggcgatatggcagcaggatactttcagcaaaaatatgaaagtggctacaatgaatttgcttatcagacagttgccagtgtagcatccggtaatggctgggattttaaatcatttatccgccgtgtcaatatcatgctttcacacattgataattctagtatgacagaggctcagaaagaccattggcgtgcagtaggatatttttttcattctttttggtatatggaattgatagatcgttttggcgatgtgccttgggtggaccaggtattgcaggaagattctcccgaagcttatggacctcgtgtggatagaaaaaccgtagccgacaaggtattggaacgtctgcaatgggcggaacagaatattggaaatttcacatcacaggatggggacaatacgattaaccaagattgtgtacgtgccgttatttcgcgtttcggattacgtgaaggtacatggaggaaatatcatgaattgggtgatgctgaaaaatatctgcaagagtgtgtacgcgcatccgagttattaatggccgcttatcctactctttacacaggaacagacggtcaacccggtgccggatatggtgaaatgtggacaacagaggatttgggacaagttccaggtatcattctctataaatcttatgtgaaggatataaatcctatgggcatgagttatattgaacatacttcttcacactatgtggagatgaaccagaatacggtagatctttatttgatgaagaatggcaagccgattttggctgacggatcgggctaccatggaaataaggacatgtatgcggtatttcgtgaccgtgacccgcgtttgtatcacacggttatacctccttataaagtaaaatctggaaaaggcgactatcctacctggtcgtatacagacaatccggcagaccgtgaatatattgatattatgggagcaaatgaaagttgcagtaacccgggtgttggtatgaaacgtttgcctgggcagaactggagtgcatcacttgtacctgaaataccaagattaggtactggagcatttgtgacttgccgttcaggctactatgtatggaagaattgggataactgggaaaccagctttaataatggtaatttgaatacagctgacaaacctatttttaaaattgaagaagtcctgttgaatgaagctgaagccaaatttgaattgggagtatttgaccaaggggttgcagacaaaacaatcaataagttgcgtgatcgtgccggtgtagtcaaaatggtggttgctgacattaatgatagttttgatcctaaccgtggaaaatactatcctaaaggtaatgaaagtggtattttggttgatcctgtcttatgggaaattcgtcgcgaacgtattatagaattgatgggtgagggatttggtatttatgatatccgtcgttggcgtatggctccgtggttcctcaataaacctgcaactggtctttggatgagtaaagaagaggcaatgaaaaataatatgactttatataatcctgaaactggttattctgatggaactgacggttcattgacggaaggtaatttgtatcttttcaatgatcctctaaaagaaggtaaaggttggttagataaatattatttgtatcaagtaccgactaccgaaatattattgaacccagaactggaacagaatcctggttggtaatttatagtgtgatacgaatgaggctgtctcaaatgcggaataacgtatggagacggtcttgtttggtttttaaacttagaaaaatcgaaataaaatgagatttcagaaaataggattgactactgtagtgttgtgtaccgtaggaatacaacagagcttttctatcgatatagttacaaaagaaaaacctaatatcgtgtttattttggctgatgatttaggttggacggatttgggtgtaatgggcagtgattattatgaaactcctaatatagaccgtcttgctacagaaggaatattgtttgacaatgcttacgctgcagccgccaattcagcacctagccgtgcttgtatgatgacaggaatgtacacgccacgccatggagtatatacagttagtcctcccgaccgtggtgatcgtaccaaacgtaaatatatagctattcccaatgtagaagatgtctgtgccgactttgtgactatggccgaggctttgcaagaacagggttatcagtgtggtcatatcgggaagtggcatttgggggatgatgaggacggtacaggacccttgtcacagggatttatatggaatgtgggcggtaatagagcaggagctccctattcttatttttatccctattgtctgcctgataaaagtaaatgtcatgtgggattagaagaaggtatattgggtgaatatcttactgatcggttgactgaagaagctgtttcttttataaaatctcatagtgaaggtccttttttcttacatttgtcccatcatgccgtacatacggttttgcaagcacctgattcattgataaataaatatcgtaataaaactcccggtaaatatcataagaatcctatatatgctgcaatgattgaaaaactagatgatagtgttggtaggatatgccaagttattaagacattaggaatagcagatcgtacaatagtcattttttattcagataatggaggttcggaaccagtgacagacaattatccgttaaatggaggaaagggaatgccttatgaaggtgggagccgtgtgccgttgattataaggtggactggtaaaatagaaggaggcatccgttcatctgttccaataacaggagttgatttttatccaacttttgttactttggcacagggtaagattcctgctaacttagatggaaaagatatttttacgcttataaataataatgagacggaacgtgatcttttctggcattttccggcttatttggagtcttatttaaacgggggaagagatttccgtgcaaaaccttattccagtattcgttcaggtgattggaaattgatatatcattatgaagataagtctatggaactgtttaatttgaagaatgatctgggagaatcacaagatctatcaggttcaaatcctgtaaagcgaggagaactttatcagaaactgatgaagtggattcaagaaactcatgctcctattcctgtgaaattgaatccttattatcgagagtaggtgaatgatatttttttcttctatagctttgcagcctaggatattttctctaaattgccgatgtttatagcaggagtagtaattattaaattcagtaaaaaacagaatatatgaaaaatcgaaacctctttcttttaaccagtggattagcatttcctctattaggcgcttatgctcagaaaactcctaaaccgaatatcatttatattatgtgtgatgatatgggttatggtgatttagggtgttatggtcagtcctacatcagtacaccgaatattgataatatggctaaagaaggtatgcgttttacacaagcgtatgccggtagtccggtgagtgctccatcacgtgcgtcatttatgactggacaacattccggacattgtgaagtacgtgggaacaaagagtactggcgcgatgcccctgttgtgatgtatggaaataataaggaatatgccgtggtggggcaacatccatacgatcccggtcatgtgattatacctgaaataatgaaagataacggttatactaccggtatgtttggtaaatgggcagggggctatgagggatctgtgtctacgccggacaaacggggtattgatgaatattatggttatatttgtcagtttcaggctcatttatattatccgaatttcctgaaccggtatagtaaatcggctggtgatacggcagtggttcgtgtagtgatggatgagaatatcaactatcctatgtttggtaaggactatttcaaacgtccgcaatattctgcggatatgatccatgaagaagcaatgaaatggttggataaacaggatggcaagcaacctttctttggtatttttacttatacgcttcctcatgcagagctggcgcagcccgaagattctattctgacaggttatcaaaagaagttttttgaagataaaacttggggtggacaggaaggatcaagatataatccgtcggtacacacccatgcgcagtttgccggcatgattactcgcttggattattatgtaggagaagttttgaacaaattaaaggagaaaggactggacgaaaataccattgtgatttttaccagtgataacggcccccatgaagaagggggagctgaccctaccttctttggtcgtgatggcaaacttcgtggattgaaacgtcaatgttatgaaggggggattcgtattccgttcattgtgcgttggccgggtaaagtacccgaaggaacggttaatgatcatcagttagctttctatgacttgatgcctacattttgtgacttggcaggtgtgaagaattatgtgaagaagtacactaacaagaaaaaagacatggattattttgatggtatttcttttgctccgactttgttaggacaggaaggacagaagaaacatgatttcttgtattgggaatttgatgaaaccgatcagattggtgtacgtatgggagactggaagatggtagtgaaaaaagggactcctttcctttacaatcttgctacagatattcatgaagaccatgatatcgctgccggacatccggatattgtgaaacaaatgaaagagattatcagaacacagcatactccgaatcctcatttctctgtgactttgccttcatttgaataaatagattttttattctgatattcctcaatctattcatttagattggggaatatttttttatgttccataaacctgctatctttgcctcgcaaatttaaaaatattccgatgagaatttaaaacattcatttccatacaactatttgtttttacgttggaacagcaggcgaaataatttcgtttgttgcgcaatagttgtcttcttattccaactacgaacttttcagtattcatatttaaaattcttagaaagagtatgtgtatacatgtacagtccattacttacatgcatccggataaagatgtgcttttcagtaatgtcagttttactatcagtaaagggcaaaaagtagccctcatcggaaacaacggttcgggaaaatctaccttgatgcgattgataactaaagagctattaccttctgaaggacaaattatatgtccggatatcccctattctattccacagcattttggtcagtttaatcatttgacagtagccggggcattgggaatagaaagaaagttatatgcacttcatgccattttacagggagatgcttcgatagagcattttacggctttggcggatgactggaaaatagaagagaaagcggttgctgctttgaatgaatgggggttggtaggagtacctctttcctatcccatgcatttgttgagtggcggtgagaaaacaaaagtttttctagcaggaattactatatactctcctgcttttatcttgatggatgagcctaccaatcatttggatgacgaaagccgtatccggctgtaccgttttataactactgctacggcagggatactggttgtcagccatgaccggacattactcaatttactttcttctacctatgagcttactgcaaaaggtgtcacttattatgctggaaattacgatttctataaagaacagaagaaattggctgtagaagctctgcaaacccggttggaggagaatgaaaagcaattacaaaaagcccggaagcaggcacgtgaggtaatggagcgtcaacaaaagcatgatgtgcgaggtaaaaaacaaaatgtgaagaaaggagtcggaaagatggcaatgcatacattcagggatcaggctgagaaaagtgctgtccgtttaggagatgttcatgctgataagatccgtgttttggcaggagaaacagtagaactgcgtaaagctttacctgatatgaagacgatgaaagtaaatttcaattcatcttctttgcatatcggtaagatacttatcgtagcttcaagtgtgaattattcgtatggagaaaatcctttgtggtcttctcctcttgagtttaccatcaaaagtggtgaccgtattcatttgaaaggaagtaatggtagtggtaaaacaactttattgaggttgataaccggaagtcttgctcctactcaaggttctttgatacaggcagaagggctgacgtacgtttatcttgatcaggaatattctacaattcgtaatgatttgtcggtattagaacaacttgctttattcaatagtgaattgtatgataatgaattgagaacgattctcaaccgttttttgtttcctgtttccacatggaacaagaagtgtagctatctgagtggaggtgagaagatgaaactttctctctgttgtcttatggtgagtgcacaggcccccgatgtttttattgtggatgaacctactaataatattgatattctgagtatggagatcttgaccgaaactttgaaggattatcaaggcactttgttggtggtgagtcatgacaactattttgtgcaacaaataaaggcagataagcagattgagttattctgatgttttattttatcaagtgcggcatttttgttttaaatatagagtttgacaaaaatgccgcagacttgatttattttattcggagttattattgcagtgtcagcgtctttacttgtaattcagcatctttagaattaccccctaccattatatcgaagtttccggctatggtgcgcatggtatttgtctgcgcgtcccaccattccaattgtttgggtgttaactctaattctacattgactgtttttcctgcaggaatttgtacacgtttgaaagcacgcagtgttttagtcggtccttccgtatcttcttgttttttcagatatacctgtactacttcttccccgtcacgattaccggcattggttacaggaataaccattttggcagtttcccctactttaatcgtttgctccagtttgatgttaccatagttaaaagtggtataactcaaaccataaccgaacgggaaaagaggatcacctttaaaataacggtaagtgcgtcctgtcatattataatcttcaaagtcaggcaattgcgctatattccggtaaaaagtaacgggcagtcgtcctgcaggattgtaatctccaaacaagacttcggcggcagctttacctccggattgtcccggataccatgcttgtaaaatggcctgacaatatttggtttcgggctccatagcaatgggtgatccggaaaaattaacgaaaataacttttttcccggcatcacagagtgcttttattaattcacgctgaacagctggaagctcgatgtcagtacggtctcctttgcggaatcccggtaaattgacacccatctcctctccttccaaacttggagatataccgcctgcaaatataactatatcagcatctttcacttttgctaccgtattcttaatgttgacttcttctttaaacccaagatcaaaattcaactgtgcgtctccactaaagtattggaagcggatttctatatcgtatggcttgccggcttctgcatgcatggcgtaagcttgtcccctgcccccatgtttgttggtgaatttctttacttcttcaccatttatcaataattgtgtagctccacaactataaaagttgaaaataacctctcctgtttcttggggggtaaacacactttgatagatggccgagaaatcggtcagattcacaccgggggcaaatacggtggctcctgaggtacaaaggcggaacggggtggtgagttgtgcggtggctgccgcatttccttcatattccttgttgttccaatagcgggcggagaaccctggaccttctttagaagtacactggttgaaaacgcttctgattaatgagcgttctacccagctgcaaccttgttcatagatcagtttgtcattctctcccatggctgagcggataccttccaataaggtgatcgtatgtttgggagtaccgttataattaccccattgcatcacagagtcatttgcgttaggtcccatgacggcgatggtttgtccaccgcgtttcagtggcaggatattatttttgttcagtaacagcgtcattgatttgcgtgctatatctagtgacagggaatcatgttctgccgagcaaaccacagaataaggaattttagtccattccactttactgggatcgtccatttcacccaattcaaagcgtgcttttaataatcgttttacggatacatcaatatccttttcactgattaatccttttttagcgctttctactaatgctttataactagaaccacattccagatccgtaccgcttaatactgcggcggcagaggccgattcagcgtccggatgtgttttatgtcctttttcccgatagaaatcgtcaatggcgccacagtctgagagtacaataccttcatatccccattcctgacggagaatttgcatcagcaggcggtcgcttccgcaacaaggatctccttccagacgattgtaggcacacattacttcttttacttttccttcctttaccaaggcttcgaaaggaaccagataagtttcatgcaagtcacgtggttttatattttcggcattgaattcgtgccggttccattccggtcccgagtgaacggcaaagtgcttggcgcaagcgtgtattttatcgtatttttgatttgcatccgtgcattgtagtcctttcactacatttacccccatgacacttgtcagataaggatcttccccatacgtttcaatacctctcccccatctgggatcgcgataaatattgacggtgggtgtccacatagtcaaaccttgataacgctcgtagcttcctgcagccgagtaagctgtatttttggcccgcgcctcatccgatactgccgtataaatggtatgtatggcgtcgggttcaaaggaagcggccattcctatgggttgtggaaagactgtagccagtccgcttcgtgccactccgtgcaaggcctcattccaccaattataaggtttgatgcccaatctttcgacaggtttggagttgtccatcattaaagctactttttcttctaatgtaagttgctgcaataaatcttctgcccgttcttcaggagataaattactgtttttataagccggttggttaccgcaaccgctcagaatcacaagggaagcaaataaatatagaattctgtttctcatagtaaaatagtaaaaatgattagttacatggcaaaaatagaataattatgagaatagtccgtgtattttttgactaaaatggtgggagatattgttttttgtacgaaaaggtgaggaatatataaaaaaactccggtcaggtatataagctgaccggagatgtattgagaacagcaaataatgactatttatattctgcccagtctatcaagcgcatatcccctttcttggccagtgtatcatgcatagccagtgcggcagaaatacaatgaggagtctgtcctttggaagacatttttacatagtcccaaagaatgttcttatagtccggatgtgcacagttttcgatgatggcttgggcgcgttctaccgggctctttccgcgtaagtcggcaacaccttgttcggtaatgataatattgacatcgtgttcgctgtgatcttcatgagaaaccataggaacgatggcactgatttttccttcttttgccacagacggacaagtaaagatggaaatataggcattgcgggtaaagtcaccagaaccaccgatgccgttcatcatcttagtgccgctgatgtgagtagagtttacattgccataaatgtctgcttcgatagcagtattgatagagataacaccgaggcggcgtataacttccgggttatttgagatttcggacggacgcattaccagtttgtcacggaagaagtcgatgtcatcataaattccttgcagacattcgtttgtgacagtcaatgaacaagtacttccaaatttcacacgtccttgacgaatcagatccactactgcatcttgcagtacttcggtatacatttcaaaagcagggattgtcttgtctcgtcccaaagcgcccaatacggcattggcgatgtttcctaccccactctgcaatggcaggaagcttgcaggaataatgcctcgtttcatatcagcagccaggaagtcggcaacgttttgtccgatttggtcggtgataggatccggtgcggtgaatgaacgggcctggtcaggtgtgttcacttccactactccgatgattttcttcggatctacctgtacgtaaggtaaaccgatgcggtcactgggcttgaagatgggaatttcacggcggtaaggcggatcaagcggttcataaacatcatgcagccccataccgtttttactgtgggcggcgttcagctcgataattactttatctgccagacgtgcgatggttggagcgatacctccggcagctgtcaggtatactttgccgtcgggtgtgatttcgcatgcttccagaatggcaacatctactttgcccatgaagccataacgtacttcctgtgccatttgtgacaagtggatgtcattatatgctatttcaccgttattcacggctttacgaaaatcggggttggttgtgtagggagcacggtaacggattgcttttactctggacaagatcccgtctgtagcatcccctgtagaggcgccggtaaaaatactaatttggaaaggattacctttggcatgttcttcttctgctattttggcgacttcgggggttacggctttgggtgttcctgctggagtaaagccactaagtccaatattgtagccatgcttgatgtagctggctgcttcggctgcggaaataatattaaatcccatgatattcaatgtgttattctttattagtatagttgttattaatattttcgattaaaaatttctgaataaatgaaagcacgccgcgcctcttctttagtactcagttttataggagtccggttttccctcttattttctgccagaggtgaagcgaccgcttttctgattattgactggttctgcatacgggaggactgaggtttgcgaaccgccggagctggagaaacagacaccttttcttccatgctttcctgctctatttcaggaaacatatctgcaagcacttccttgggggaaggtgttttcttctctttgccggcttttgagatttgttgtacgatagccacaacaatgattactataaatatgagaacctgaatgatatccatactttccttattatataatgaatgctcaaagttagaaaaatatttcataaccaactctataaaaggacataaaaaaaggaagagaacttcacagttgtcttcccctatttttttaacctaaaccttaactatgaaaaaatctaatgtttttcggaagcaaatatgcgaattataataatacgttggtaacgttaacggtcttttttgttcactggttataattatttaacagttaaatgcataaatctcttataatatccaattttcggctcttttattcgtttaatttgtcggtaactccgtatctttgcctacgaaaccataaaacagagaaaatatgaaagaaacaacaggagcagactttaaatctgcaactgattccgagaacaaaaaattgtttattgaaacctacggatgccagatgaatgttgctgatagtgaagtgattgcttctattatgcaaatggcaggctaccatgtatgcgaaacattggatgaagcggacgctgtatttatgaatacctgttctattcgcgacaatgcagaacaaaagattctgaaccgtctggagtttttccattctatgaagaaaaacaaacgtcggaatctgattgtcggtgtgttgggctgcatggcagaacgtgtaaaagatgatttgatcgagaaccatcatgtagatcttgtcgtaggaccggatgcctatctcactttgcccgatttggtcgcttcggttgaagcgggggagaaagccattaatgtggagctttctactacagaaacctatcgtgaggtaattccgtcccgtatttgcggcaatcatatctccgggtttgtatccattatgcgtggttgcaataatttctgtcattattgtattgtgccgtatacccgtgggcgtgagcgcagccgtgatgtggaaagtattctgaatgaggtgcgtgacttggcagccaaaggttataaagaagtaacgttgctaggacagaatgtaaattcttatcgttttgagaaagagggtgaaataattactttcccgatgctgctccgcacagtggccgaagcggttccggacatgcgtgttcgttttaccacttcacatcccaaggatatgagtgatgaaaccttgcaagtcattgtggaaacgcctaatgtatgcaagcatattcatttaccggtacagagcggcagttcgcgtatattgaagctgatgaaccgcaaatatacccgtgagtggtatttggaaagggtagcggctattcgccgtatcattcccgattgtggtctgagtactgatattttctccggctatcattcggaaacggaagaagaccatcaggaatctctatccttgatgcgtgaatgtgcgtatgattccgcctttatgtttaaatattccgaacgtcccggaacatatgcttccaaacatctgccggatgacgtacccgaagaggttaagatacgtcggctgaatgaaatcattgaattgcagaaccgtctttctgctgaaagtaatgcccgtgatgtgggtaagaccttcgaagtgatggtagaaggtgtttccaagcgttccagagaacagctttttggccgtacacagcaaaacaaggtggtagtctttgatcgtgggaatcatcgtatcggtgattttgtccatgtacgcattactgaagccagttcggctacattgaaaggagaagaggtgttctgatggggaaaaaagaagaatataaggaaaagaacttgcaatatttgcaagttctttctacacaggaaggtatttgttctttaccttgtaatatgttttataaagtattgcagacaggtacgggtacagtttcacctacgatccgcagtattgtcaccgttcattatcggggtagtctgataaacgggaaagagtttgataactcctatgaccgtaactgtcccgaagctttccggctgtgtgatgtcatagagggatggcagctggcgcttcaacgtatgcatgtaggagataaatgggtggtttatattccttatactatggggtatggtagccgtacaagcgggccgattcctgctttctctacattaatatttgaagtggaactgctgggcattgcataatgcctccggttatcggttatgcagcctgtcattcatccggtcttcgtaaccgtcacgatatttcttttcgggcataacaatccataagattatatagacaataatgcccgaaaaggctgtgaaaaccgtggcaaatgaatagataatgcgcactatcgtaacatcccagccaaaataatcagccagtcccgcacatactccggctagcattctgttgttggaacgggtcagttttttattttccatttctgtctcttttgaagttatctgcacaaatgtaggaaaagtaaaaacgaattattaacttatactcttaaaagtacttaaaggatagttcttctcattcaatttatttgttattttgcagcaaattagggcaaaaagtggatatactcaaaataaatacttgtccgttgtgcggcggaaaacatttgggacatgcaatcacttgtacggatcactatgcttcgggtgaacaattcaatttggttcgctgcgatgattgtggctttatttttacacaaggtgcacccgtggaagccgagatagggcgatattatgagactcccgattatatttcacacactgatatccgcaaggggctgatgaaccgtgtataccatgaggtacgcaagtatatgctgtcacgcaaagccaagctgataaaacggacatccggtttgagtaaaggtactttgttagacattggtaccggtaccggatatttcagtaatacaatgaaggagcgcggatggcgggtgaaagctatagagaaaagtccgcaggcgcgtgcgtttgccaaagagcattttgaactggatgtagatacggaggatgctttggcgggatatgccgatcattcttttgatgccattactctatggcatgtgatggagcatctggaacatctgaatgaaacgtgggaaaaattattcaaacttttgaaagagaggggagtattgatagtggctgtgcctaatcccagttcgtatgatgcggaaaaatataaggaatggtgggcagcatacgatgtgccccgtcatttatggcattttacaccttccgtcatgcaacaattcggcgtcaagcatggttttaaattagcggaacagcatccgatgccttttgatgctttttatgtatccatgttgacggaaagatataaaggcagccgtttgtcctttttgaagggaatgtggacgggcctgttggcctggttcagttcactggcgaaaaaagaacgcagtagttcaatgatttatgtattcagaaagaagtgattatgggaaaaaaatcagggtcctttttcgatatgcagttcattacctccagcatcagtacaatgctggtgttgctcttgttggggatggtggtattctttgtgctgtctgccaataacttatccaagtatgtacgcgagaacatcagtttctccgtactcatcagcgatgatatgaaagaagcggacgctttgaaattccagaaaaaattgaatgaggaaccttttgtgaaagaaacttcctatatatcgaaggagcaggcgttgaaagagcagagcgaagcgatgggtacagacccggctgaattcttgggatataatccttttacagcttctattgaaataaaactgaatgccgattatgccaattcggacagcatttcttggatagagcagaaaattatgcagaacaagaaagttatggaaatcaactatcctcaggatttactggatgcagtgaacagcaatatacggaaaatcagttttttgctattgggactggctgcgctgcttacccttatttcttttgcgctgattaataacaccatccgtctggccatttattccaaacgttttctgattcataccatgaaactggtaggggcaagctggggatttatccgtcgtccttttttggtgcggaatatatggatagggatactggccgctgccatggcagatgcggcattgataggaatggcctatgcgttagtaagatatgaacccgaattgattgagattattacccctatgaccatgcttatggtaatgggttctgtttttgtgtttggtgtggttattacctttatgtgtgcatatatatcaatcaataaatacttgcgcatgaaagctagtgcgttgtattacatttaataataaaaggatatggatagacaaaaattcgcctttgataaaactaattttatattgcttgccataggtatggcagtgattattgtcggttttctgctgatgacaggacctagttcgacagaaggatattttgagccggatatttttagtgtacgtcgcatcaaagtggcgcccgcagtatgtttctttggctttatatttatgatttatggcattgtccgcaagccaaaggacaagacagaagtggttaactcttgatttttttaatttttaattctcaatttttatttaaagaatggaatggtttgaggcattgatccttggtttgctccaaggattgacagagtatttgccggtcagcagtagtggtcatctggctatcggttcggcattgtttggcatacaaggggaagataatctgacttttaccatagcagtgcatgtggctacggtactcagtactttggttatattatggaaagaaataggctggatattccgtggcttgttcaagtttgagatgaatgcggagacaaaatatgtgatcaatatcctggtatccatgattcctatcggcattgtgggtgtgttttttaaagattatgtggaagaaattttcggttccggcttgctcattgtaggttgtatgctgttattgacagctttgcttcttactttctcttattatgcaaaacctcgtttgaaagagaacatcagcatgaaggatgcgtttattataggtctggcacaggcttgtgccgtgatgccgggattatcccgttcgggtactaccattgctaccggtttgttgttgggagacaacaaggcgaaactggctcagttctcttttctgatggtgattcctcctatattgggtgaggcgttgctggatggtatgaagattgtaaaaggagctgcagccggcacatcagatatatctgtattgtcattgattgtaggttttctggcagctttcatatcgggctgtgtagcttgtaagtggatgattaatattgtgaagaaaggtaagttgatttattttgctatctattgtgccatagccggtgccgttacgatagcgtgcacattgatgtaattggatgaattttaaagaaggagaagtattatactttgataaaccgctgaaatggacctcatttgcagtggtaaacaagataagataccatatttgccgcaaactgggcgtgaagaaaataaaagtgggacatgccgggacattagacccgctggctaccggggtgatgattatttgtacaggcaaggcaacgaaacgcatcgaagagttccagtatcataccaaagaatacattgccaccttgcagttaggggctaccacaccttcattcgacctggagaaggagatagatgctacctatcctacggaacatatcacccgcgagttggtagaggaagccttgcagcgttttatcggcaggatagaacagattccgcctgttttctcggcttgtaaggtagatggtaaacgcgcttacgatttggctcgaaaaggtgaggatgtggagttgaaagccaagacgttgattatagacgagatagagttgctggaatgtaatctgcctgagattaaaatcagggtagtgtgcagcaagggcacttatatccgtgcattggcccgtgatattggcgaagctttgaatagcggtgctcatttgacagggctgatacgtacccgggtgggggatgtgagactggaagactgtttgtcggtggaaagttttccggaatggcttgaccaacaagagattgaagaagttataaacgaataaggagagataagatgaaactgtcgcaatttaaatttaaactgccggaggataaaatagctttgcatccggctaagtatagagatgagtcgcgcctgatggttgttcacaaatcaacaggtaagattgaacacaaggtattcaaggatatcctggactattttgatgataaagatgtgtttatctttaatgatacgaaagttttccctgcgcgtttgtatggaaataaggaaaagaccggtgcccgtatcgaggtatttttgttgcgcgagctgaatgaggaacttcgcttgtgggatgtgctggtagatcctgcccgtaagatccgtatcggtaacaagctttattttggtgacgatgattccatggtggccgaagtgattgacaacaccacttcccgcggacgtaccctgcgtttcctgtatgacggctctcacgacgagttcaagaaagcattgtatgcgttgggagaggctccgctgcccagtttcatccgtcgtccggtagaagaggaagataccgaacgtttccagactatctttgccaagaacgaaggggctgtgacagctcccactgccggacttcatttcagccgcgagttgatgaagcgtatggaaatcaaaggtatagactttgcttttgtgacgatgcatgccggactgggtaatttccgcgagattgatgtggaggaccttaccaagcataagatggattcggagcagatgtatgtcaatgcggatgcgtgccgtattgtgaataatgccaaggatgaaggaaagaatatttgtgcggtaggaacgacagtgatgcgcacgatagagactgcggtaggtacggatggtcatctgaaagaatttgacggatggaccaataagttcattttccctccttatgatttctcggtagccaacagcatggttactaactttcacctgcctctctccactttgctgatgctggtagctgcctacggtggttatgatctggtgatggaggcttatcacacagcattgaaggaagattaccgtttcggtacttatggcgatgctatgttgattttggataagtaataccggttggagcagcgtatgagggtttatttgggacttggaaccaatctgggtgataaagaatcaaatctgcatgttgctgtccggaagataaatgagcggataggggaggttactgccctttccgctttttatgttactgccccttgggggttttcttctgaaaattcttttctgaatgccgcctgttgcgtggagagtgtgcttcctcccttggatatattgcgggaaacacaggagatagagcgtgaattaggccggatgaagaagtcggcgggaggtaattatagtgaccgcctgattgatatagatattttgttgtacggtgatttaatactgcatacgccggaattggaaatccctcatcccttgatgactgaacggaggtttgttatggacccgctggcggagattgcatcggatgtggtgcatccggtattgggaaaaaggctgggggagctttaaacctgtaagagtatattaattaaaagaggacggaaaattcttcaaatccgtcattgtggtgtagatagctgattgatagtgtattgttatgaaggattcgtaatagaatccttcataaatgtttcagatgaatcaatgtttataatgttattatattttgtcatggatataatatctatgctcatatttgtttctgttaaatcattacaagaataagatgttagtaataataggaataagtatatttttctataagaggttttcatagtcattagatataaatatattagtaaaaaatagtgctgattgttaatacttatcaaataacaatcagcacatggaatattagatcttaatttgggaaatgaacatggagttatcggctgcattagcaccagagaaagaaatagggactccatatatttctttactatatactcctccttttattataaaatcttgaaatgcaggaaatccagtaacaactttagctgcgtcctctccgttaccacctataatataaatatagatctgagcacgttttagcatttcttttgtctttgagtctagtgatagttctccgtttactattcctgcattgaatgctgctcgaattgatacagaaatttcactatatgattcttcagattctactatcattactccttttcgtcccatattcacagaattcacatatacaggtttttgatttagatatttttggcgttctgtttcattgagaaatatgtttccatcatctgggatatccatagctacattaaaatagatttggctgaaatcaacaaataaagcggtattactttgttttttatcactctcaacagaagttgtaattgaaaaaagctgtcctatttttatattagctccaaaagccatatttacctctttgtaataattaaattctttcattttatatgagaaaacttgcgattgttttccactaaaatctttacctgcatctgtgatagcgtctataactgcatcattaaatgaggtaaacttaggttttattactcttgatttgataggcaatgagaatgcaattctgatttctggttttaaagcatttggatatgcaacagaacggtattctccggtattaatagattcagcttgtaaaacagagcctaaatatgtataagcagggttcaagcttgctatttcataaaattcttgggtggatcttgatagatactgttgtaatgttaaatctacctctttaccatctctaatttcatatattccatcatagtaaagagaacttagtggagcaatgtttgctgtattatttgctttcgaagaaatttcatctaaatcttcgttttcacaagaaaacattacaaggaaaacaattgcaaaataaaaatactttttcataggattaaatttttaatagattatttgatagaatgggctgttgagcagcgaatattcacgagtgtattcagttgcattccacattcgcataggttcgttaggttccataggcatggaacctgtactttcgtaatatgatgaattatagccaacatatatttttgatttaaaatcaatgtttctcattataattctctctgtcttatctgtacaatttgcatttatcataggccagtttttataattgggttcatagttgcatttattttcaaacatacttatattgaagataatatctatatagggttgggaaggttttgtcttttctctatctttataaaaatacaaataaagttggcttgacgaatgataatcgcttttgttggaataatcaggtaagtatgaattattttcacgacttggctttacatataaaggttctatatggatagtattgataaattcagtttcaaccaatccatgtgaattggcataggagaaagaacatgtaataggtacaccatagcttgtttctgtgaattttgaattatatattaaatttaggaaatggctatatcctttaaatgtttgtacggccagattgctatctccccctataattagcactttgaattctgtattttcaaagaatttttcttcttctttattcagagtagttgttttcttactgaagattctatcaaattctttttttatacacgtttctgcgaattcgtatgattcgtctgtttcaaaggcaatgattcccagtcttccataagtcaatgaattcacataaacaggctcatattcactttttccttgaataggttggtcacttaaaggagcaatatccatgttgacggtgaaacttgattggaagaatttaacatacattcctgttgacttttgtattttatccctgtattctgttgaactttcactttttgaagaaaatagttttcttgtattaatatttgttccgaatgcggttttaatttcatcgtaaaagctaaatctcttgtaactgaacatgaatttctgattctgttcgaaatttccatcggttaccatctcaaccacataatcacttaatttagagaaagtgggtgcttctatagttctgctagtgggtttgggtgtattgtgtgccaatgtcattgatactgttatgggttttctgttgctgataaataccggtatataattttggtttgaaatgctatttccttctaaaatggatcctggaaatatgtaatttcttccatataaaacggttgcttctgtacttttcacaatatattgtttattgaaaaatgcatcatcttccggtgaaagtgatcttgatgttttgtcttccagattcttattatattgatttatccaattctgatatagagaatctcctggatatgtatataaagagtctattttaacaatatctttatattttataagactgacattaggggtaatatgggctaattctgttgcttcattgcatgagcagattagcgttacgcctagaagtatgtgtaaaatagaacggatgcttttcataatgatgattatttattgtacattgaaatagttaacaaatacagaattatcttttatgttagaggcggaaaatgatataggtcctccgaaatcatcgggtgtaactgttgaagataaataagtaagtatgcttgtaaaaggattgtctgggttgatatcttttattcctttgtttccaatagtcatcaatctgatattagaattggctaatattgctagttctttttgactaacttccttagacttcagtaaattgtcaatagtttcttgtaatttgtcataatcaatattactttcaataactagtataacttttctgccaaattgtattgagtttataaatgcaagcttgtctaattgttgcaaaacttgtggatcagtgcttagtgattccggcatatccattataatgctgaaaaaactttgatttatatctatcaatataatattcttttgaggcttataatcgggtgtgatgcctaatagttgctgaaggttaatattttgtccccaattgacagctaattcttggtatgattttatctttttaattacgaatgaaaaagaatagttacttttcaaaacatcgtttgtttttaacgcttcatgaatagctttcatcatgttattataggaaggagtgattgtttgtgactttataggaatggtgtaccccatgtttataggattcattgatattttcaggaacttatatgtgtcttgattgatgctgttggcttccaatattgctcctatgaatatttcattggggcattttgccacaaacttatctgcactatattgctcttcttggctataagcaagtttagcaatcatcaaaaatacgatggtgtatattattttagttttcatttctttgtatttaggttttatactcatatttattcaaaggtatattttcttttcagccatataatggaaaggaaatcttgattcattagttctgaataagagattagattatactcttgtcctattgccataaatgtacgttggtcattattgttttttattatatagaatcctatattgagtattactcttccattttcgtctttttctccacagtattcccatttatctattggcttctggtatatgaataattttttatcttgccattttagtttatacttttctactatattattggtttttacaatggaaagggagtccctatcgaattgtaattcatgggggcaagaccgttggattcgttctccgaaatatgcagtttctgtttctgttaggtcttgaatatcgtttttattgagtatttctttaaattctactttttcagaaaactttagtttcaatatgtaagaagtgtcttccggtgtgggaagaataggagagggatcgtccttgtctgcgcaagaactaaacataagtgttcctattgaaaggagaaaggacatgcctacaataagtagagtgctttttttctttttcataatattggactttagttttcgtatataaattctcctgccaatattcccttttcatcggtgattgtcagttcatatattcctgccggaatattctctaaagaagttgataaagaagaattggagtggggtatatagaggtttctatatactacatatccttcttttgatttaatctcgatggttaccgcttcccagtcctgtgcgaattcgatggttaattctttattgcagtcgtcaaagaaagcttttaccggaatgaatgactctactggaattctatggttgccatgttttataaattctatatttcgctttttagcgcataataatagaggaataattaaggctatcaaagccaagcttatttttaatttgttcataatcgttttacgttttagttttgtacaaacttaggtattataggattatgaatgacaaaaagagggagttatagtatatacaagatttgttgattatcagtgagttacagaaattgttatatacagtgatgtatatgtagtgttttataattcactgataataagacctgtatgagaactatttattttaagaggtttttgatgatgtaatctcgtaaaaacgtttctttatcgtgctttagttggacctcttgataaattctcgttcgtttcattcgtacagaagccggattgatgccaagcaattttgcttcatcatttgcgtcaaatccaaaaatatggagatagcaatattgatattctgattctgtcaggttgggaaatgcctcttttagtagggagtaaaattggggatatatcttgtctacttccgtcattatggaatgccatgttttgtcagtagggagttgggagtcctcaagcctattttttttagtcaaagaaataagcttcttgccaactgtggatgtttccagactttgcttttgcagccggttgtatttataggatattacttctatttcctgttgtagtttgtgggcattattctctttgtctgccaatgctttttgcaaaatctgctttttttcttctagttctgcagataagtgaaggagctctattttcatcttatctagaattgtttgctggtaatagattttggctttgcttctctgccggtaaatgatatatcctgcaactgatagtaagaataaggagatggcaataatgatgatgattgtattcctttgctgtgtaatctttaatagttcgttctcttcccgtatcttggcattgttatactttttttctatttccaatacttttgtctcattttgaactaatgtcagtgaatcgagcatgtcggaacagatttctttgtaatggagtgcttccttgtattttccttctgccttataaagcaggtagtaagcttgattgaagtaataagcgatatcattgtgtttggttatcgtttcaatccattcgtgtgcttttgccagttggttgtcttttatatatatgtgtaatagggagatagaatccttatagctttctttgctgcccgtttcaatggcttttaagaaatatctttcggcattcttgtatttttcttgtgcctcatatatcactccaaaagcattggctacatcagctgttaaatctttgttatgcagtagttgtgagatggaatcagccttttgaagtaagggtatggtgcaattaaaagaatcagtgagtgtacattcacacgctaaatcttttaaggcgtatgcatagcttttgtagttccttgctttcttgaagaagttactggcctcttttcttttctccagacgttcactggttatatctctaaaaccatacaaatctgccatataggcacaaatataccctgccacattataggcctgatgttctttggccagttgcagcgcatcggcatatatttgcattgctttatcatactccccatcttctacataagcacggcccagatacaagtctatttgcgcctgttcttctgccgtgccgtgttcggtgaaccattgttgtgcccgttgccattggtagatagggagtaatccggtggctgcttcgtccgttactttaccgcatagcatacaccagtgggcaaagtccttatcagtcagttcatcgggggcttgtatgctgtccagtagcacagaagcactatcggcatacatgggaatcagttcctctacagattgtaatagcggaagtatgcttgtctcttttctgcatccggggaggatgagaatgaatagtagtcctgtcaaaagtaaagctttcataagaatgtgttcagattttgcaaatatagtcataaatccgggcaacttgtatctgatagagggaaaagtcagttttttatgctttccgtggcttctcctttggaagtgaggtgggaaagcatgaaagctctttgtcttgtcagtgaaatctgtctgttgttttttgttcttctgccttttcatcaaattttatcactaaagtgaagaaactgtatcactttagtgatgaagtttgattaccttagtgatgatctttcatcactaaggtgaaacgattaaatgaaaaggcagagattgggagaaaataccgatggaaccactcaagttacaggaacggaattcattttgtttgcgccatttataacggttgtaatgttgtgctttctattgaaatatcctatgacaaaatgatgaagaatttatgaataaatcaatcatggtaaataattggttatcaacacttaataagtaaatgaagaatttgaaggaaataatcagccaactggatactgtaactccttgtgttttgaatccgttgtttttacgccacaaatcttctggtccatttgcatgcatacatccctctgaccaccaggtagctgatgagaaaggctgttacggccatgcaaataatgtgtattatggcaggaatcccctgaggcaacagcgaggcgaacaagtcatatcccatttgcacgaagacgaaatgacacagataaatgccgaaggtcatggatgccacttttgaaagaacaggcgaagaaggtattttaagcttctgtatgcagacaaaaacaggaaatgtcatcataaatacattgatgccgccgaaaagccatactatttccagataggcgtagtttcccggaaaatattcctgcatgatgaggtagccgccgaaagtgatggcgtaccctgtcacaaacatagggataccgatagccagggtttttctccaactccattgcagcgggtattttaccagataatgggccagtatcagatagccgataaatccggaaacataataaaatgaaccgaatgcattccagtcgcacactcccaggatatccatattgccccagttgccgatatatcccagtgcgggagcggccatctttatgtagggaaggaacaaggagatgccccagatggaaagaaatagcttgatatctttccgggtagcacgctccagccatgcatggaagatggggatgatgaagtagagtcccaccagcatatacagataccacagaggagtggtgtcatagttgaaattgaaaatgaatgtccaaatcttcgtgatagtcatttccagggtgaaggcggacatgtctatggtaggattgtctgtcgtggtgatgtaattcagataaatgaaatacaatacaggcagcatgaccgaccagaagataagcgggacaacaatgcggccgatccgctttttgtaaaattcactcatgccgtttcgtacaggaaacagcagcactcctgtcatcatcacaaacaagggcacgcaacagcgtacggcacttcccaatgcgcacccttgcagaaaagtaggacggtctgtgtcaaaacgtgccacaaaagggtcacagcaatgggcgaatacaactaaaaaacaggcggtgacgcgtagcaagtctatccatccgatgttctctcttttatttatttccatattttctgttgggtttatttttgttcaagcactattactaaaggacggtgatctgatgctaccggttcatttactacctgtgcggaggttactgtgaagcctttcatgttctgtttcagtgctgtaatataatcaatggtttctgtaggggcgggagccggaaatgtatgctggtttacgtcagaaagtatctgaaaatcctgttgcaagtattttatgaatgcggattcgggttcggcattcaggtcgccggccaggaaaaaaggttttttatgagcggcggcaaagtcttttataagctccagtgaggccatgcggtcttcttcggtgagagacagatgggtgcaacaataaatgtagttgtcgaactctgccataatcagcgcacgtgcttcttcccgtccgggaagtgtcatggttttcaggctgacgggaatttctttggtgagaagtccgataccatattttcctccgtcgtaatcaatggcaggggcaaagtaagcgtgcatttgcgtacgtccggctatctcgcccagtacgtatttttgtccgctgcggtgggtcatgctgtctagttcctgcaaggctaccacttcggggtggatatgattgattacatcggctatgcgttggaagtcgcatacatcatccattccgtttgcatttttaatgttataggtcattagccgtaaggaattttgtgattgtgccgacagggcaaaaagaagggtaaaaagtaagggcaatgtctttttcatatattcatcaggttttgattgtttaaattctctccaaagatagataaattcattctttttttctttgctctcaaagataaaaaacaagagaaagtttttatcagaaaggaaatgtttctgttcaacaacttgccggggctttatttctttcctgccggagaagcttgtgtcatacggatactgcttaccacacctgcggcaatggcaaagaatatggctaataataaacaagcctgcgcccgatgtccttcggcgaatatacggaacaacaaagcaaccaatgtggtccccaaagtctgacctaacagacgcgccgtacctagcataccgctggctccaccgcttctatgagtgggtgcggaagaaacaatggttacattattgggcgtctggaacagcccgaagcccataccacagagtgccattcgccagatgatattccattctgccggatgggtgggaagcagatagagtgtgaataggccggtagcgaagatagtcatgccgatacctcctagcaatccgggatgtactttctctaccagtctgcctgcaagtggtgcggtcaagatggtagccaatggccagggggtaagtaacaaaccgatctctacggcgctgtatcccaatatattctgcataaaaaaaggtaaggaaaccatagccagcatctgggcggtgaatgaagtgatggaagtaccgatagaaagagcgaaaataggaatcttcagcaaatctacaggcaggataggggttgtttccttcagttggcgacggatgaaataagtgccgattatgattaacaataccaattgtatggcaatgaattttctgttctcagcgtgtgcaaaaccttccaaagtataaattaacaagccgaaagtcaatgcgttggctattgcactgattctatcaaacttatgttttacatctgaagccggattatgcggtaataactgatgcccgattactaatgcagccaatcccaaaggtatattaattacgaataaccaatgccagcttcccaatgtcaggatactgcctgcgatggacgggcctgcagcagccgaaacagctaccaccatggcatttacccccattccgcgtcctagtatctgcggcgggtaaattaaacggataagggcggtattgacactcatcacacaggctgcaccgaaaccttgaatgatacgggaaacggtcagcatccagaaagagtccgagagggcgcaggccgcagaggcacccacaaaaatggagataccggtcaggaatattcgtctgtaaccataaatatcacctaatgaggcaaatgatagtaaggtcatggtaatcaccaattggtaggcattaataatccagatggcattggcgggggtgacatcgaaatcgtgtgccagcgtgggtaatgcgatattcataatggttccgtccagtacggacatcatgatagccagcagtacggctaccaccgcaaaatattgtttaggtataaatgcgatcttttctttgctcatgatgcaaaattaacggaaatcggccagattaggtttaatttcttctaaataattacgattccaatgttaaagaaccgggaatttatagaatggttaaggaataatgcttatctttgcagccgttaaaaacagtggagagatttgagtagcttgcaaccacagaaaaaaatgctaaaaaatacattgactttcttatttacatctatctactctgataacttcccaaggtggttaacgaattaacttttaatttttaattcttaattttcaaattagaatgggatatttattcacatccgaatcggtgtctgaaggacaccccgacaaagtggccgatcaaatatcggacgctgtgcttgacaaactgttggcgtttgaccccagttcgaaagtagcttgcgaaaccctggtgactaccggacaggtggtactggctggagaagtgaaaaccaaggcgtatgtagatttgcagcgcattgcacgtgaagtgattaaccgtatcggctataccaagagcgaatatatgttcgaaggaaactcgtgcggcgtattctctgccattcacgaacaaagtgcggatattaaccgtggcgtggaacgcgaggaccctatgaatcaaggggcaggcgaccagggaatgatgtttggttatgctaccaatgaaacggaaaattatatgccgctgtcactggacttggctcataaactgttgatggtattggccgaaatccgtcgtgaggggaaagtgatgacttatctccgtcccgacgccaagagccaggttactattgaatacgatgataacggcaaaccggtacgcattgatacaattgtggtttctacccagcatgacgagtttgtaactccggctgattcttccaaagaagctcagttgaaggctgacgaagagatgttggctaagattcgtcaggatgtgattgaaatcctgatgccacgtgtcattgccgaaattcataatgaagaagtattggctttgttcaatgaccagatagtttatcatgtgaaccctacaggtaagtttgtgatcggcggtcctcatggagataccggtttgacaggccgtaagattattgtggatacatacggtggaaaaggtgctcacggtggtggggcgttctcaggaaaggaccccagtaaggtagaccgcagtgctgcttatgcagcacgccatatcgcaaagaatatggttgctgccggtgttgccgatgaaatgctggtgcaggtgtcatacgccattggtgtggcccgtcctatcaatatctatgtaaatacgtacggccgcagcaatgtgaaactgagcgacggagagattgctaagaaaatagaccaactgttcgatctgcgtccgaaagccattgaagagcgtttgaaactgcgtaatcctatttatgaggaaacagcttcttacggtcacatgggacgtgagccgaaagtagtgaccaagacatacgaatccatgtatcatgaagcaaagacgctggaagtggaactattcacttgggagaagttggattatgtggataagataaaggaagcgttcggtttgtaagaaacggattcgaatatggtgatgtatacgggcgaattcaattcgttcctgcggcaatgagtgtcattggccggcaggggaggattggatccgcccgaaaacataaggatttatatgaatgatataaagaatgtatgtgtatatagtgcctccagcacaaagatagcaaaggtgtattttgatgtagcggaagaattaggacgtcttttggctgaaaagaagatcaatctgattaacggggcaggctgtatcggcctgatggcggctacttcagatgcaacattggaggcgggcggtacggtgacaggggtaatccctcattttatggtggagcagggatggcaccatacagggctgacccgattgattgagacagaaaccatgcacgagcgcaaacggatgatggccgatttgtccgatggcgtcattgcattgcccggaggttgcggcacattggaggaattgcttgaaatcatcacctggaagcagctgggactttaccttaatccgataatcatcttgaatatcaatggattctatgactctttgcttgaaatgctgcaaagggcggtggacgagaactttatgcgtaaagaacatgctgctatctggaaagtggcctcaacagccgaagaagcaataaatttgctttatacaacgcctgtttggagcaaagaaatacgtaaatttgcagcgatatgagtgaaacctgccatcccggaatagcgtatattctccaactttatacggaagagcagagccgtgttgatacggctttgacacacaacgtgtgtcatacgtccaaggaagacgggatgagaggaatggagttgccctatcaactgcgttcggactggatggtgaccagcgtgttgtttctttgttttattctggtatcatacgtgctggcacatggcaagaaacaccttgaacagcaatttaagaattttgctttgtctaaagagcgtgccagtttgtttgatgatactactgcatctgatgtgcgttatacattggtgctgatattgcaaacctgtatattatccggtttttgtgtgtacgattatttttctgatcacgacctgctccttttccgtacggttcctcattatttattgctaagtatttacattggttatatagtttttttctttgtcatcaaatggattctttatagctttgtaaattggattttctttaacaaaacacgcaatattatttggctggaatcttactttaatgttgtaattggggccggatttttactttttccaattgtacttttgattgtgtatttcgatctgtcaccacaaattgctccttattttatcggttttgttataataattgctaaaattctgctgttttataagtgctttagtaactttttcaacaaatttcatggcgctttccatttaattctgtacttttgtgcccttgaaatactccctgattttgttctgtggaaagggattatcttagcgaacaacattttggttttaaatttttagtacattgaaaataaaaaaagtcctcgtatctcagccgaagccgacttctgaaaagtcgccatattatgatattgctgagaagtacggtgtgaaaattgatttccgcccgttcatcaaagttgagagcttgtcggccaaagagttcagacagcaaaaagtctctattcttgatcataccgctgtgatttttacatcgcggcacgctattgaccatttcttcaatctgtgtgcagaattgcgtgttactgtgcccgaaacaatgaaatatttctgtacgtccgaaaccattgctttgtacattcagaaatatgttcagtatcgcaagcgtaaagtattcttcggcgcgaccggtaaattcgcagatttggtgccttctatcgtaaagcacaatacggaaaaatatttggtgccgatgtctgatgtacacaatgatgagatcaaaactttattggataaaaataaaattcagcatacggaggtagtaatgtatcgtacggtaagtaatgattttactcccgaggaagagttcgattacgatatgctgttgtttttcagtcctgcaggaatcaattctttgatgaagaattttccggagttcgaccaaaaggaaattgcgatagggtgttttggtcctgctactgctaaagcggtaaaggatgccggattgcggttggatttggaagctcctactgtagaggctccgtccatgactgcggcattggatatgtttatccgcgagcgcaataaagattaatttttagtttatatcccaaaaccgggggttttgtatcaataaagttgtaactttgtgattcgaaaccctcggtttctttattttaataaaagaaagaagattatggtagaatatacactcggtaaaaaagagcgtttgaatagtaagacattgattgagcgtctttttttaggtggaagcaagtcttttccggcttttccgctacgtgtggtgtatatgtcggtagagcctgtggaggaagatatggcggcagcttctattctgattagtgtgcccaagaagcggtttaaacgtgcggtaaagcgtaatttggtgaaacgtcaggtacgtgaggcttatcggaagaacaagcatttgttgctggatgcgctagcttcccggaacaaaagactgattatcgcctttatatggctggataaccatattcattcttctgcagaagtggaggagaaagtgaagaagttgctgtttcatatagtggaaagattggaatgaaaaagatactttcctatctgttgctgttgcccgtttatttctatcgggggtacatttctccgatgactcctccttcatgccgttttgtacctacctgttcggaatacgctattgaggctattaaaaaacacggaccttttaagggattatacctggcggttcgtcggatattgcgttgtcatccgtggggtgggtcgggctatgatccggttccgtaaaatctgttgttcctatgttgctggatattcatacacatcataaagagggcattccgggagaaaatattctcaatgtagaacccggactatttgagcctgcggaaggctgctactattccataggtattcatccgtggaaggttttggaaactgagccggaggattggaaacggctggaggatgcggctggccatccatctgttttggcaataggggaggcaggtctggataagttggcttcggctgatatcttgctgcaaaaagaggtgctaatccgacaaattttattgagtgagtcagtaggaaagccgttggtgattcattgtgtgaaggcgtttaatgagctgattgagttgaaaaagcggtatcggccgcagatgccctgggtggtacacggtttccgtaataatttgaatattgcctgtcggctgatgcaagaagacatttatttctccttgggggaaaagtatcagcctgatgtgctgcagaatgtgcctttagagcgtttattggccgaaacagatgaaagtccgctggatatccgcacggttatcgggcaaatggcagaggcgaaagatgtggcagtctccttgttgtgtgatagaataagtgaaaacacacggaaaatcttttttcagcgataagagttgtttcttcagataaagagtcgtacttttgtagcattaaagtataaatcaaacatttaaatagataatcattcgatgaattttgtagaagaattaacatggcgtggaatggtgcacacgatgatgccgggcaccgaggagttattggctaaagaacaagtaacagcttatctgggtattgatcctacggctgattctttgcatatcggtcacctgtgtggtgtgatgatgctgcgtcatttccagcgttgcggtcacaagccgttggcattggtgggcggtgcgaccggtatgattggtgacccttccggcaaatcgcaggaacgtaatctgctgactgaagaaacattgcgtcacaatgtggcttgtatcaagaaacagttggctaagttccttgactttgagagcgatgctcctaacaaagccgaattggtgaacaattacgactggatgaaggactttactttccttgatttcgcccgtgagataggtaagcatatcaccgtaaattatatgatggctaaggattctgtacagaaacgtttgaacggtgaggctcgtgacggtttgtcatttacagaatttacttaccagctgttgcagggatacgatttcttgcatctttatgaaacaaagggctgcaaacttcagatgggtggttcggaccaatggggtaatattactaccggggccgagctgattcgtcgtaccaatggcggtgaagtgtttgcattgacttgtccgttgattacaaaagctgatggtggtaagttcggtaagactgaatctggtaatatttggttggacccccgttatacttctccttataagttctatcagttctggttgaatgtaagtgacgaggatgccgcacgttatataaagattttcacgtcactgagtcaggaagaagtggaagtattgacagcagaacatgctgaagctccgcatctgcgtgtattgcagaagcgtctggctaaggaagtgactgtgatggttcattcggaagaagattataatgcggctgttgaggcatcaggcattctgtttggtaacgccacttccgaagcattgaaaaaactggatgaagacacgttgctggcagtgttcgaaggtgttcctcagtttgaagtgtccaaggatgtattggccgaaggggtgaaagcagtagacctgtttgttgataatgccgctgttttcgcttcaaaaggtgaaatgcgtaagcttgtacagggcggtggtgtttcgttgaataaggagaaattaaatgcctttgaccaggtaattacaactgctgatctgctggacggaaaatacctgctggttcagcgcgggaagaagaattattatttggtgattgccaaataagaaaaaagagaatttcttttatagataaaaataaaaaccggaaggagaaatgataggttttcttcttccggttttttgtatcttttttctccttatttcccgtctatctctttcaacaactcgtctaccgcagctttcaactgggtatcttcacctttcactactgtttccggtgagttagccactttgatatccggctccagttgtgagttttccagatagcttccatccggcaagcgatagccgataacaggaatgccgaataccagtgtcggatcttgcaatgtttcccaagatacgctggtcatggttcccggtacaggcatacctaccagtttgcctattttttgatggctatatacccatggagtgccatgtgcgttgctgtagttagcctcgcactgcaccatgatactcggtttgttccaacggcggctgggcatatcgcaagcttcacgtccacgaactacttgtgtaaagtatttctttccactgaatagaatctcgatatcctcgtgcagacgtcctccgccattgaaacgggtatcgatgacgataccttcacggttattgtacttgcccagaatatctgaataaacggaacggaagctgtcatctcccatggattcaatgtgcacgtatcccaaacggccgttcgaccatttgtctacatcggctgcccgttgttttacccagcgtgcgtaaagtaagtcattcaaaacgccattgctgataggaacaactacttcttcccaacgttctttggtctgcgggttataaagtgtaaccagtgttttctttctggctttaccgttcaacagaacagagtaatcgctttcgggagtgatttcctgaccgtcgatcttttcaatgatatctccggctttcactttggaacgggcgtggtcgaaggggcctttttccactacctcagaaatcaacaggcctttgccattatgattccagtcatacaataatcctaaggtagcggtggcatctcctttcaggcgcggacggtaacgtcctcctgtgtgtgaaacgttcagttcgcccagatattcgctcaacaactccgcaaagtcataattattattgatatgcggcaggaacttgcgataggctttggtcatagtatcccagtctattccgtgcatgttcaggttgtagaagcgtttttgttcttgtttgtatacgtggttgaacatatagtcacgttcggctgcgaggtccatcttcacgtgggcttgatagctgatgggtttcaagctttcagaattagtacccattttctgcatcgtgttgctacctagcaagaataagttctttccatccttgtccattcccatgttggcccatccggcatccattttatggagtaacttggtgtctttcttgcgcagattcattttccacaggtcatagccgccttcgaaggcagagaggtaatataaggtttcaccgtcttttgtgataatggcgctccccaaatcggaagagttgggagtaaggcgtacgatgcggtcctcgatgttgttcagttccaccacgatgtcctttactttttcctctttcttctcttcggatttttctttgttatcacctttctttttaccgtttttcttggtttcggttgtgttcttttgttctttttccagttctttttgcaattcgtaatcttctttgctcaggcggaacttgtcatacgcatcttggttcataaataccagcatcacatcgtttagtgatccccatgaagcatgggcacgcataccataacgttcggtaatgaataaaatggcattaccatccagtacccagcggggggagccactggtatagccgctattggtcagattgataatttttcctccttgtgcattcaccatacctatatcggaatatggatcatgccggtttccgataaattccaatgtgaaccatttgccatccggtgaccatgaatagtcaaagccaccgccggtgctgaaccaggtggagccgtcagtgacctgacgtacctttttggtttccagattaagcaccatcaaccggttacggtcttctataaaggctagttccttcccgtccggcgagaattgcggataggtacgttctgtcttgtccgaaggcaggagtacttcttcttcaatggtagtcgcattggggaagttagcttcctccttacgtgcaatcttggccatgtaaagttcccagtttccgttgcgttcactggcgtacgctaaagtacggttgtccggtgagaaagtaagtcctgcttcacgggcaggggtatgtgtgatttgcttggtagtattataatcggcagaagtgacgaatacttcacctcgtacaatgaaagcaatttgtttaccgtccggtgatacggtagctgaggtcgctccattactgaaattcagatccgctattgtattttggtcatcacgggtgatatcgatcttgactttctgcggtttatctccttgtttttgagtgtatatttctccatcatacgtataacagagagtgccgttgctacccattgacaggaagcggaccggatgagtcttgaagttggtgaccgtttccaatgattgaggactacttattggaaaggaatatacgttgaatgtaccgccgtttcgttcgctcaggaaataaacggtttgtccgtcgggtgcaaatacagggttacggtcttcgcctgcatgggcggtcaggttggtatgcttgccgttttctgaattatataaccatacgtcacgggtgatggacgaggtgtggtgtttgcgccattcgtcttcaaaacctttgcggtcttggtagagaaatgtttttcctgatttgtcaaagcagaccatttctgcgggagtacccagcacctgttcggtacgtccgccggttacagggactttgtatagttctgtcatagctgaggtagggaacaaggcactgttggcagggtcttggatggaggccgagaacaggatatagttgccgtcggtggtgaaggttgacggtatttcggaagccgaatgggtggtaagacgccgggctgctccgccatcggccgacatgacaaacaggtcgaaattaccattgcggtcactggcgaaggcaatttgtttactatccggtgaccagatggggttacactcatatgaggcttgcgtagtgagttgggtggcagttcctccgttggagggtactttatagatatctcctttataacagaatgcaatttccgtgccgtcgggggaaatttgcacgtcacgcagccataaaggtgtagctgcataactgcttgctgcaacaaggcttaaagcaaggcaagttagaagttttttcatgtatttatttcttttagtttgtacgcaaagttaagcatttgcactttattgcaaaaaaaagtgcgaaaatatttggactatattgcaggaaaaacgtatctttgcaccgctttccaaggaaagcacataatgattggactatggtgtaatggtagcacaacaggttttggttctgtttgtccaagttcgaatcttggtagtccaacaattttcaatctaaaatgaaataaaaacccgttaaacatatagtttgacgggtttttttcgtatccggtcgtcacagttttaaaaatagccctataatcagggcccaattggatgccaacaatttgctctcattgctttgggtgacttgtctgagtaagaacaaagatacaaaaataaaagtctaagtgtttaagatattgtttttataaaaaagttagagccattcttcttttatactacagatttatttttgaaatttctcctgtttctgttgtttgattcatatttgcttttctcttctatatttaaagaatgcggtatctgtctatattaaagtaaaaataagaatgaatagggtactgaatatcgggaatatgacaaataaaaatagttacaatatctacatatctcttggcaagagatctataaagtatattgcaaaaatacgtaaattactggtaataagcaataaaaaacaacgataattctatattaaagaaataaaaagttatgataatcaaagtttatatatgtatttggtgaaggatatttattttataactatctgtatttcagtgtgttaatcatgaagagtatatctcttgccaagagatatatcgtaacgtagcatgaattgatataaattatagatataatgaagttaaaaaattatgcaatcttgctttctttcctgcttggtggaagtgcatttgtgaaggcgcaggatatcgcgttgaagagcaatatcctttatgacgcctcaggcactatcaatttgggtgctgaggttggtcttgcccccagatggacgcttgatgtatcaggcaactataatgggtgggtccgttcgcatggtcgtacgtggaaacattggatgttgcaacctgaggcacgttattggttctgtgatcgttttaccggtcattttgtgggcgttcatgctcacggtggacaatacaatgtgggtaacctgaagaatgacatttcgtttttgggtagtgatttgtccaaactttctgatcgtcgttatcaaggatggtttgtaggtgccggtattgcttacggttattcgtggattctttcccgctactggaacgtggaggccgaaatcggtgtgggttatgcctatacccgtttcgatgcctatccctgtgccgattgcggcaccaaactgattgatggcaaatcccatcactatgtaggccctacaaaggtcgcactaaacctgatctacgtattttaaaagatactgcttatgaagaaattactatgtatacttcttttgttattttgcataataggaataaacagccagactattctgacgttgggacgtgtaaaagtagacggtctgaatattgctcgtagcggtgagaatctgcttgtgtcaatgaatattgatgtggcaggtattgatatgccgtcttcccgtgaagtatcttttgctcctgtgctccgtgcggagaataatgaattgtttctttctcctgtagtgctggcaggtcgtaaccgttattatttccatttacgcaatgatgctgctccaggtgtgggtatttcactgtttcgtgccggtcatgaccgggtaattcattatagcgccatggtgccatatgctgaatggatggccgacgctactcttgagcttggcgatgaggtgtgtggttgtttgtgcgaggtacttttgtccgaccgttcgccgttgactacgctggattttcacccgaagattttctctccgatctttgtttattgtgttccgaaagcagaggagctgaaaacccgtgaactgaaaggttccgcttatattgattttccagtgaaccgcacggaaatttacgaggattaccgtcgtaatccgatagaacttgctaagatccgtgccacgatagacaccgtgcgcaatgatgctgatacccgcatcacttctattcacattaagggctatgcttctcctgagggtagttatgccaataacacccgccttgcccaaggacgtacggaaacattgaaggattatgtacagcgtttgtataatttcccgtctggtgtcatggctacagactacgagcctgaggactgggcaggactggagcgttatttgaaaacttgtacacttccggatcgttatggcattttggagttggtgcacagcggtggtgatccggatgcacgtgaacagaaaatcaaggcgcgttatccccgggactatcagtttctgcttcgtgaggtctatcccggtcttcgtcactcggactatacggtggaatatgtagtccgtgcttatactgatatagaagaggcgcgtcgcatttggcgtactgccccgggtaagttgagtttgaatgaattttatcgtgtggcggagagctatccggcaggcagtgacgagtataatgaggtgttcgaaaccatggttcgtctctatcctgatgatgctacggcaaatctgaacgcttccaatgtggcgatgtctcgcggtgatcttgtttcggcgcgtaagtatgtggcaaaggcaggcggcacgcctgaggcggtatatgcgcgcggtgtacttgccggactggacaaagactatgtacaggcacgccgcttgttgtcgcaggcacaaagcatgggtgtgaaagaggctgccgatgcactggaacagattaacaaaattgataagaagtaataataagaaaataaggaatcaatatgaaaaagtttagtaagattttgatgtccgggcttgcagcattgtgtttgtgggcatgctcagatgaggcaaatgtgtctcagccggccaatgctgagaatgatgtatatgtggaattcggggtgcaactgatgcagggaagcagttcaaggagcacgacaacagatggtgaggatggaaacggaagcaattctactggcggtgctgaagtgggcaagaattatgagaatagtgtcaaggagatattgttggtgctgacaaaggctgacggatctctcattgtcagtcaacgtctggatgtggaacctaaagaggatggaaaataccccagacttgtgacaactttggacagaagtgcattggagacatacaaaacaggagagatttacgcttatgctttctgtaatcccatttcttctatcaatatcaatgatctgacccatagtattcatacgctgtcggatgaacctgaattattaacagacaacgatgaaatctggaaaaaagacgctttcctgatgtctaaccacaatttggtgaaagtggcaaattctaccccgaatacgatttggaactgggaacaatatactgagtccaatcgtctttctctgggtaccatctcggtggaacgtgcttgcgcacgttttgatttcaaagcgagcagctatcccactacagaggctactaacacttatgtgctggagagcaccaatggcgtcaaagtcctgctgactgatatggtaatggtcaatatcagcaagagtttctatcatctgcgccgggtgtctgctaacggacttgcggatgatatagacttgtgtggacaggaaacttcaaacaactatgtggtggacacggatgcaagggaaaagaacggtaatgtcggagaaacttataaaggtaactatttttataataacttttttgctagatcggcagctgaatgggaaaataaattcacaaagatatcttctttgaccgaagaagacaatgacgaatcttggaacacaggcaatcgcaacggatacaaaatttggcgttatgcaaccgagaataccatccctgctcctaacagtaatcagaaaaacggtatctctaccggtgtgattttcaagggaaaactacaatttaacaagtcaacttatggcgtaaccggtgatcagcccatttttgtatataacaatgtgttgtatggtacttgggagaaagtgaaagatgtggctaatgctgccaacgcagatgagagcctgagagccgcttatgcccaaataggggaaacacccgctgccgatgctgaatttggcaaagcaggattcactgttttacgcccgaacggaagcggtgactatgaaatgtattattgctattggaaccgtcataatgacaataatgatcctaacctgatgggaccgatggagttcgctgtggtgcgcaacaatgtgtacaaactgatggtgaacaaaattaacggctatggccatcctacctcgccgggtcctaaagatgatcccgatccgttcgatccgaacaatccggatgaacgaaatgacctctacatcgaagtaaccgtagaagtgcgtccttgggtggtccgcataaatgacatagagttctaaataagtacttattataccctattaaacaatgaataagacaacaagattcatacatacattaagattgccgggcatggtgctttgcaccgtgctggcggtagctgcattgttgtcctcctgccatggcatatacaatgatctggaaccctgctcgcaaggtgtccgtttgcgttttgtctatgactataatatggagtatgccaatgcattccattcgcaggtggactgtctggctctgttggtctatgacgaacagggcaactacctggttacttatatcggtacaggtgacgaactgaaagatgagaattaccgcatgaccctcgatttggagaaaggtagttatcatttcattgcatacggcgggctgacttgtccgaaaacctctttttcgttcaaggcggttcccggcatcggttcaatcatgcaggatttgcgtgtagagatgcataatgccggacgtgtttcggaaaccgatctgcatcccttgttccacggctcgctggacatgagtgtggacaatggcgcttacgaggaagcgactgtgtacctgatgaagaacaccaacaacatccgtgtggtgcttcagcagatgaacggcggcgaggtggacgacaagaactttactttccgtattacggatgacaacaccttgtttgctcccgataacagtctgataagcaatggcggacaagtctatgctccatggacacaagggcaacgtacagtgggagtgacagaagaaggtgatgaaacagtgacagtggcatacgccgagttttctacctcgcgactggttgccggcaatcatacgcgcctgaccatcacccgtaatagtgacaatgcgcaggtactgaacattccgctgaacgagtatctgctgctactgaagagtgatcacttcgacaaaatgggtgatcaggaattcctggaccgtgaaaataactggtcattgatatttttcttggataataatcacaattggatacgtacccatattgttgtcaatgactggatagtaagaattaatgatgcagaattatgagaataaaggattggggatataccgtggtcgtgctgggcgtctgcttcctcctgatgtgcggatgtgacagcagaagtgatgaggggctttcgttatctaacgggcctgatgcggtctatctggatatcaatgtcgccctgagagatgcttccgcatccggacgttctgtttccggacgtgcggaggaagaaatgtatggtgaggtgacggaagccgagaagatgcatacgctgcgtgtcattctggttcgtccggatggcagggtggaacataatgtctatcttgatttgaagaatgcttctgtgagcgaccggtatggaaaaatccgcctgaaggtgcagggcaatgaggaaaagactatttacctgctgggtaacgaggggagtgcttcggtggaacttcccgctgtggagggtgaggtgtctcgggtatccaaagcttggggcgactttaaacccggagacaaatttcttgccaaggagcagatggcagggcttgtgttgtcgtttgacaatgtgggggctttcgataaaactcacccgctacctatgagcgaatgtcatacggtgatgctggatgacgaaggtctggaacctgacaatggggagcagggacagaccggtgaagagggtgagaaagtggtactgaaaaagaaggagatcacattgaaacttacccgtgctgccgtaaaattcacgtatgagataacgaacaagagtagccgggattactggttgagtgtaatcagaatagataagtcggcttctcatgaatatcttctgcctaatggtatgacgtacgatgatgcggaaaatgtgactgatttccaagtaccggcagctaaatatacaccgtttaatcagctatacaaggagaataagaaattgacagcaaaatcaacggagccggtcaaactaccttcattctacctgtcggaaggaaagtatgagaatgccaatgacacatattcagataatacgaatggcaataattataagacttcctacaagaccgctattacgctggatacaaaggataatagtggtgaggtgttaggcgacagggccggaaacacttccttcggggagttcaccttggaaagtttctttccgaatctttctgctttgcctcgcaatacccatgtggtggtgcgcatcaccatcaatgatgcgaatgacatatcatggcaggtggatttgcgtccatacggcgaagtggtacttgaacctgaatttggaatataatgaaaataaggagaagagaatgatgaaaaataaagcgatgcgttgtgtttggttggtatgcggtctgttgatgcttgccgttacctcgtgcaaggacgatctgctgtacacggacggggaacctattcccgaaggagaaaccacaataatagcacaggtggacttccggccactggtggaggggcttgcgggcaaatcgcgtacggcgggtgatgctatcaagtccattcaggatttgtgtgtgttgttgtatgacacggaaggaaattttgtagagggacattcgttggaatcgataagcaatgcaaacccgactgatggacagttttatgtgaatgaggtaacacgcaaggatggggatgcacctgatggtggcactatagccgaaacgaaaaccccacaagcgaatctcaaattgaccattccttacggacgttattacatctatgcggtagccaatatgggagaggactttaagaaggcggttcaggcgcatgggaaggaaaatggtgctgcagaggaggttgcaaagtataagacagctattgcaacgaaagaaggattaaaaagcatttctcttacttgggatgttgctgatgtggctaagaacagtcagatgttcggtcatttcaccatagtggggcaagagaataacagtgaattgatcactatcaataaaaagggcatgaagttgcattcctggatacgccgtgcagcttccaaggtaacgattgcatacgatggcagtaaactggaagagggtgttttcatttatttgaaatcggtgaccataaaggacatcccgcagaattgttgtctgggacaggataatcctgcagttccggaaaactatcaaccgaaggatagggacgaaggagtaaagcttgatttgataaaaaatggtgaaaccataaaatattatgaaggtgacaccgagccgactataagtgattttaaggaaacatacgaagcccgtattacgaaggggaaacctctattcggcagtaaagaacagggtgaaaacgcatatcatcccaaaaagttggcggatgtgcataccgaaattaccaacgctctttatttttatgagaatatgcagggtaagggtaaagaaggtactcctagtgataaacgtcaggtggttgcaaatacccttaataagaccgaaccgacctatcctaacggaggtcaagagaacaatgaagcatggaaagatgccaagccatacggaacctatatagaagtggatgctttttatgtttctatcaatgataagaaagtgggtagaggtcctatcaagtaccgctttatgttaggaaaagatgtgataaccgattataatgcggagcgtaaccatcactacaaactgactttgaagttcaagggatatgccaatgatgcagactggcatatagagtatgaagaaccggagccgggtatcgaggttccgaatccttattatatctcttatctttataaccgtacgatgaatcttccggtaaagattaatacgggaggaggtacacttacgtctttaaaagctgagattctcacgaataattgggcaccgtatggaacacttcctttggcgaaaggtgggttggattatgccagacaatatgattatgctgaaaatccaagtaactcatcgctaaatcaaccatggaatggatttctttcacttcgtaaaactgctgccagagttctagcttgtaatcaagaagggaatgctaaggatcaggtaccctccggtctaccagaaggagcaatggtaaatatcagtagcaataaggactattatgagacaacaaataaaggagttcgtaaatatgtagtgggaaatggaacacatgaggaagcagacggtaattacagtataactgaaaatgacgatcatttacttgcttctattcctttatatactcgcgccaaacagatgcatattaaaacgggttatacaggaaataatccgtatgtggcttatcagcggcatgcaaaagttaaaattaccgctatggtaaaagtgtcagacatagaacatacacttgaagaaactgtcgatatatatcaagtacgaagacttgtgaatcccaaaggcatttatagaagcaataacaaaaatgagccttttcatgtaactttattgcgattgccaagggaaaatgcaacagagtttattcctttttcatccgaaggaccttggaaagcgtatgttgtaaatgcacaaacagaggctgatagaggagatcccccttatacagatcctaatcgtggatttatcagtctttctgtttcagatacagaaaatacaagtcaggatgaaaagggggttatacatggtgttactggttcggatattaaatttgatattaattttaatggaacaatagcagcggatgcccccaataggaatgcgatagtgcgtgtggaatatcataattatacctgcgaacatcttattttcgtgcaccaaggaaaccggccgcagaagttgttatccgacaagccggcatggcatgtgtcgaatctggtcagcaagaatagggaagcttctaatccgttggatgaaggctctttgtttaaatataaaaatcttgatcagcctattgctgcaaagaatcagtattccagtaagattccaatgatagatgtaacctccaaggatttccctgatcctgtatcaaatcagaataggtatgaattggtaggtggtgaaatcaagaagtggatggagataacaaatcagcctgcaaataataaagaggcttcttgggggcttgacttgacgagtactcgtattgctcaaatagaggattatgaggcattgtttgaaaacgaaatgattgcgcaaggttatggtgtgctttatggggatgaatctacggaacccaaaacaaacattgtggatgcatacggatatcaagaagatcaagcatattacttcggtggaagtgctataaaagaccgtggaatacgtggatgctttgtttataatagaaatacgggtaatcatatctttcttccggtgggggcttccggatatggtcatagaaaagctaaagaaggaaatggagttctgcgttattcttgcgggcaaactcagatattcccaacgaatcctaatggattctatactgatgcatctaccgctccgttattttatgacctctatatgcggcccggtgctatttattggacagaggatgttactggaacaggaacatggggaacgactgtaggttgggatattaattattttacatttgactttaacagaatatatgaggctaatgtgtttaatggaaataacagtgacgcctgcttcatccgttgcgtagaagatccaaattagtttctttttaggcaaatataaacaggacaatcgcatccaaagttgctggaacttggattcgattgtcctgtatgttgttcatgtacgtgcgtgaatgtttgcaaatatttctggtgacgctcttctcttaaagtttcattttctgctgccactgctaccaccctatgtgtagggtgttcttgaaaactaccgggattaacgatgcagcacatttacaatttccaccacatacatcttgtgaaaaccaccgtgcgattccccgtaccatcggtctgtaatgctcttgtcgataaagtttctgggcttgatcaggtcggcatacaatttcttgcattcaaaagtcagccgcgcctgctcaaaaataatgctcccgttctcggtgaacaagggagatagtcctgtcgcttttactttatccatgtcacgtcccgatttggaaccgcatattttatgcacttctttatgctcttcacctagaaaagagagagtgagatagtcattctgctctataaagtcgaatgtataacgctcggggcggataaagataaaggctaccggacggttccatagaaatcctgtacctccccagtttgccgtcatagtgttgaatttgtctttggtaccggcagttaccaacatccattccttgctgattgtttcgaacagattgtcagtcagttcgtttacttttatttctttcattgtttccgtatttttagctagtacaaagatataattttttcttttactgtttcagattaaatttgctaattattatctttgcgagaaatattaatttaaaaaaagaaaggacgatacagtggtaaatgatgtagttttaaccccgatgatgaagcagttttttgagttgaaggcaaagcatcccgatgcgattatgctattcaggtgcggggatttttatgaaacttattcagaagacgctattgttgcctcagagattttgggtattacgctgactaagcgggccaatggacaggcaaagagcgtagaaatggccggctttcctttccatgcattggacacgtatttgcccaagctggtacgtgccggcaagcgggtggctatttgtgaccaattggaagatcccaagatgactaagaaactggtgaagcgcggtatcaccgaattggtgaccccgggtgtagccatcaatgacaatgttctttcttacaaagaaaataattttctggctgccgttcattttgggaaagctagttgtggtgtggccttccttgatatctctaccggtgaattccttaccgcagaggggccttttgactatatagacaagttattaaataatttcgcccccaaagaggtgcttttcgaacgtggtaaacgggggatgtttgaaggaaatttcggaagcaagttttttacttttgagttggatgactgggtgtttaatgaaagttcctcgcgcgagaagctgttgaagcactttgagaccaagaacttaaaaggtttcggggtggagcatcttaagaatggtattgtagcttcgggcgctattttgcaatacctcaatatgacgcagcattatcagatcggtcatattacttctctttcccgtatagaggaagaccgttatgtgcgtctggataagttcacggtacggagcttggaactcataggtagcatgaatgagggcggaaccagtctgctggatgtgatcgaccgcactatcagtcctatgggagcccgtctgctaaaacgctgggtagtctttccgttgaaagatgagaagcctgtcaatgaacgtctggatgtagtggaatacttcttccgcgagccggatttcaaagagttcatagaagagaaactacatctgataggagatttggaacgtattgtttcgaaagctgccgtaggacgaatctctccacgcgaggtggtgcaacttaaagtagctttgcaagccatcgagccgattaagaatgcctgtttgaatgcggataacgggagtctccgccgtattggggaacaactgaatttatgtctgtctatccgtgaaaagatagcgaaagaggttaagaatgatcctcctttgctggtgaataaaggtggtgtgatagcagacggggtgaatgcagaactggatgaactacggcagatagctttttccggcaaggattatctgcttaaagtacagcaacgtgaaagtgagctgaccggcattcccagcttgaaaattgcttataacaatgtgtttggttactatattgaggtgcgtaacacgcataaggataaggtacctgccgactggatccgtaaacagacactggtgaatgcggaacgctatattactcaggaactgaaagaatacgaagaaaagatcttgggtgccgaagataagattttagtacttgaaacaaagctctataacgaattggtgatcgctttggcagagtttattcccgccattcagattaatgccaatcagattgcccgtttggactgcctgctggcttttgcgaatgtggcgagagagaacaattatatccgtcctgttgtggaggacagtgaggtgattgacatcaggcaaggccgtcatcctgttatcgagaagcagcttccggtaggggagaagtatattgccaatgatgtctttctggactcggaaacccagcaaatcattatcattaccggtcccaatatggcgggtaagtcggctttgctacgccagactgcgctgattaccttgttggcgcagatgggtagttttgttcctgccgaaagtgcgcggatcggtatggtggataaaatattcacccgtgtgggagccagcgataatatttctgtgggcgaatctacctttatggttgaaatgaatgaggcggcaaatattttgaacaacctttctagccgcagtttggtgctgtttgatgagttggggcgcggaacctccacttatgatggtatttccattgcttgggctattgtggagcatattcacgagcatcctaaagccaaggcacgtacactgtttgccactcattatcatgagttgaacgagatggagaaatctttcaagcgcatcaagaattataatgtatctgtgaaggagatagataataaagtgatttttctgcgcaaactggaacgtggcggcagcgaacattctttcggtattcatgtggcaaagatggcaggtatgccgaaaagtattgtgaagcgtgccaatgatattctgcatcaactggaaacggacaaccgccagcagggcattgccaagcctacggctgagatagcgtccggccggagcggaatgcagctcagcttcttccagttggatgatccggtattgggtcagatacgggatgagattctgaatttggatgtcaataatctgacccctcttgaagcattgaataagctgaatgatatcaagaagatagtaaaaggcaaataaatgccttcatttttcattaaccattaattactaaccattaatcattatcatgaaacacctactaaccttatggatgttggccttgtgtctatgtgtttcggccaaggaaacatgtccgaaagtaattcccgccctgcaagagtggaaggggggaagtggaaaactcgtattgcctgctgaaggcagtattgttgtagctcctgccgatgaggcggcactgaaaagtgtggcgactgtgctggcacaggacttgaaagacctgttggattggaactacaccattaggaccgggaaaccgggaaagaatgatatttatctttcattgatgaaacccgacaaacaattgggagaggaagggtatgtgctgactgctggacgctatgccggtatcgaagcgccggctcgtcagggagccttttggggaacccggagtttgttgcagattctttataatgaaaaaggacagttgcccaaaggagttgcccgtgactggccgcaatatcccagtcgtggcttcatgctggatgtgggccgcaagttcttcacaatggatttcctgcggcaatatgtcaaaatactatcgttctataaactgaatgaatttcagatccatctcaatgacaatggttttgtacagttctttgataacgactggaacaagacctacgctgctttccgcctggagagtgaacgttttccggggctgaccgccaaggatggttcttataccaagaaagaattcaccgacctgcaacgtctgggcatggaatatggtgtgaatgtgattccggagattgatattccggctcattcattggcctttacacattataaacccgagataggcagtgataaatatggaatggatcatttggatttatacaaggaggaaacctatcgttttgtagattctttgctggatgagtatctttctggcgagaaaccggttttcataggtcccgatgtacatatcggtacagacgagtacaatgccaaggaagctgaaaaattccgctattttacagaccggtatctgaagtatatagagaaatacgggaagaatgtccgtatgtggggagcactgcgctggttgaaaggaaacactccggtgaaagcagataatgtgactatcaatgcctggtcatacgactggattgatcctaatgcttctttgaaagacggatataagattatcaatacgtgtgatgcttatctttatattgttccggctgccggatattatcgtgatttcctggacacgaaatggctgtatgagcaatggcgtgtgggtaaagtgaatcctaaggaagagttgcctgaaggaactccgggactgttgggaggtatgtttgccgtatggaatgaccattgtggcaacggtgtgtcacaacaggatgtgcatttccgtacattcccagccgcccaggtactggccgagaaaatgtggagaggtaagaatgaaatggtttcttacgaagaatttgagaaattgtgcaaacagatgcctgaagctcccggtatcaacctgctggggcgtgtgcagggtgaggtagtctttccggggcagaatgaagaactgtctttgaacggtacggacagcattgccactatgttgccggaaataggctatccatacgcggtagaatttgaaataaatccggacaaagaacaaaatatcaacggtattttgtttaaaggccctcattccaccgtatatgccaattgggaaaataagggaaagctggctttcagccgtgacggctatacgtttgtattccacgctgctacactgcctgccggagcatggacgaaggtacgcatagagggagaccacaaaggtactactctttacataaacggtgagaaagcggaacgtttggaaggacgtgtcaaacagttttacaactatactcataaacgtaaggacaagatgtatatgcaggaaactttggtgtttcccatgcggcagataggggatgtgcagaatgggttcagagggaagttgcggaatataaattgcatgcaataaaagatatttctttctcttgctgtgtaggggcaggttttagacctgtccctatgcccaataggagtgaaatttctccgaatgttatctttaatagtgttatattgtttattatcaatgttttatatgcgataaatgttatctgttttattttcatgaaaagggctttataccttactttgcattattaaacttaagcaacaaacccgatgaaaataaaacaaattctactttgcatgcttttagcctgctttattcttcccgcttccgcacagaatagctggggtattgtaggaggcggacttttttctaaatctttgtccagggatgcacgcttcagcctaggcggttatgccggaggaatgtatgacgttcatgttaaaaactcatggtatgtacagccacaattattatttacttatgaagaattcagatccaagacaaggcttggtaccgattccttttttagtaaattcaatttggagcttcctatccttgcttcttataatgttgctttaaataacaaatggaatttgcgcatcaatgcgggaccgtatctgtcctatgctatgtttggcagggataaatccattgactacgcctatggcaacggaatgcactctagtttgggctggtggcatcaggattttccagatcattttacttacggtggaaggaccggggtttcattggaatccgagcatttcatttacactatcgatggtaaatgttctcttcgtaagaggcctttcgggcggaatgtcagtttatcggccggtgtaggatataagttctgagttttctgtatctttgtcgccggagaataaaaatagagttgcatgtatgtttatataaaacagccgggtattgtttgccttctatgttggctttgtctttcctgtactttgcagcgcacggaacatcctgctttgcggcaagcaggatacttgatggaagaacatgccgacagtgcgttttcattattgaaatccatctcttccctgatcggtatgaccccggaagacaaggccgattacgctttgctgctggctgaggctgcggataaaaatggttgttcactgcttccttgtgactcattattgaatttagccctccatgtataccatgaagaagccaaagaacatgctatagctcttctgtataagggtaaagtgcaacaggaaatggaaaactatgccgatgccctgaaaagttaccgtatggcgcttgaaatcctttccgcctatccatgtgaattctattggaaggggtttgtatataatatgttgggtgggctgtatggcaaacagaacttgtacgcacaggccaaagatatgtatgtcaaggcttgttataatgattcgctggcacggcataaccgtcatttcatcagttcactcagcaatctgggggtagcttatatcggctatggaaatatagactccgcttttatctgccagcaacgcgctttgcagctttctctttctactgatagtttccttttgcattctctttatggaaatataggggatttatgcggacgtacaggacggaccagtatagctattacttgtctgaaaagggcatacgatgcttgtcgtcttagagaagacagcttgcagtgtctttggaatctaggggaattttattataataacgggcagcttgattcggctctttattatttgaaccggagcaaggaagctgtcgatattcatatccggtatctctctttctttgacttgtatgccatagctaagcagcagggaaatgtggagaaagctttggaatatctggaaatcagcaccgagttggaagattccatctattccaccaatgtggccacggaactggagaagaagacctatcgctggaatgccgacgcgcaagtaaggaaagaacagttcaaggctaaacggaggatatacaccattgcgatgatagctgtggtgttgctgctggtcattgtgattatttatcaacagatactgaagaacaagaagatacagcaatccaactataaatatctgttgcagaagctgaaacagaacctgatggatatgcagcagaatattgctcaacatgaagaggtgatagccgaattgaaacagaaacaagaaagccgtgccgaggaaatagaagagaaggaacgggctatagaggccatgaagatggagaaagagaaattgcgcaactggttgttccggcaaagtgccctctatacgaaaatagacaaactggccaaccagcaaaagcatcacaaagagcgtattgcagtgctcaccaatgctgagcaacgccaactcagagtgattataggacagatttatgctgattacatagagcaactgcatacccggtatcccaagttgaacgaagatgatgtccttttgctatgtctgcaattggcggatttatctccttttgccatcgctttatgctttggtaataatgatacacagattgtagcgcaacgcaaatatcgtatgaaaagtaagatggaataactgtgtgttacagaatttgcataatgtttttttaatagatgtttgtatatcaggttataaaggcattttgctatctttgtgcatagaaagctaaaagacaaaattactatgcgttcatttattatatatttaaatttcgtcagtttgctggctgtctgtttgtttgcctgtaaccaccattcttccaatccgatgttacagcaagtagattcattgttggaaatgaagccggacagtgcattgactattttaaaaaatatatctgttttagaggatttgccggaagtagacaaggcatactatgctttgttgctggctgaggctacggacaagaacaaactacccttattaccttgcgattccttattgaatttcgccttggattattatggagatgatgatagggagaaggctgtggcattgatgtataagggaaggctgctggcgcagatgaatgatgaaatgtcggcgatagagcataatttgaaagcgttggaagtgttgcagaattatccgcaagatttaaaatgtagaagattgatttatagtatgttaggggtatggtgattgtgaattgtacgacaaggcgttggaaatacaaaatcaagctcttctttattcttttagtgctaaagatactgctattgcctatcataacattggatatatttatggtatgagggatatgcaggattctgctataacttatcagagaaagtctgtggaatatgctatgcgttctaaagatacaagcatgatactcacttcttggcacaatttaagtctgtattatggacgatttgaaaacatcgattctgccgtggtttatgcctataaagttttgcaaaatatatctgatgaaaataaaatatttagcggttatttctataatataggtgatttgtacattggtttaggacaatatgattctgctaggtattatttagagaaaagcctgctcttttctccatccctttctatgtcttactggtcacttgccgtaatggaagctaagctaggaaatttcaagtccgcctatcactatctagatacttttgtcatggttcaggattcattggatgctagtgagcgattgtctgaagtgcagcatatagtctataaaaatcagacagcattggaagtaaaggatgagcaaataaaatccagaaaggttatagggcgtattgttttttcagccattattatttgctttgtcgttgctttgatttaccaacgttggataaataagaaaaataaccagcaggcactctatcggcaagcattacaatatgctgatgagaaacagaatgtgatgcagcagcgcatagaagaaaatgaatccgctcttgcactgttacaggatagggaaaaccaaaatcttgatgaaattgcccaaaaagagcaattgataactcaattgaagaaagaaaagttggcacttcgtacatggttattccagcagacttctatatacaaaaaggtgatgtcattgtctgaccagcagcaggtgaataagaaaatccgtaaggtgatggcagctgctgaattggacaaactgaagaaaacgacctttgaaatctatgctgattatatttctcctttgcaagcacaatactcccaactgacggaggatgacttgttggtcctttgcctgcaagaagcgggtatttctccgttggccatttctttatgtttcggacatacggatacggtagccctcaatcaaaggaaatcgcgtctaaaaaagaaaatgtcagagtgataaactgaaatatattgtttatcagtgttttatagaaatattatgtcacagcaaatagttgtacgttctttcctttccctctaactttgcggcatcatttttaaacaaaaagaagtatgaaagcaaagttattattgatgttatttttagtttccttgagtttgggagtttttgcttcggagcatcaccaaaagaagcctcatgcagtttgcaaagtttatgagaaggtggctactagaattccttttattttttcaatacaagccgaagatataaatgactgtttgtatctcacatctcagttctcattaaatgatgctgatattactatgctagataaggatggtaatgaaaaggtgtagttatgaataacgcatttgaaaaaacagctgtacttcctaagtgtgataaaggaagtgcttactcgactcagataaatttaagtttttaagtaattccaattaaggctgtatgataatattttagttgataatctaaggttattgataatgtgaagttcatatctgaatcttattttattgctcatgttatgataaaatatgttatatggttgatttttagtgttgtataggtgagtgatgttatatggatagagctttatgcttatatcttctttctaattttgcaacatcaaataaaaaaataagtatgaagactaaaatgattgtagtggtggtgttggctgccatgtgtgtattgcctttgtctgcacaggtaaaagttggtgtggaaggtggaatgaacctgtctcattatctggtttccggttctgacggatataaagccgaacaggtaggtggaatgaagcccggctttcaattgggggtgactgtggactacgagataggaaagcattggatgttaatgtccggtttgtcttggttgcagaatagaagtaccatgaaaatgatggatcacatggttacttattttcctaagacagagataaagataaataatctgattttgccgttaaaaatgggatataatattcgggtttcggataaactcagcctcattccgtcggttggagtttatgcttcttacggatttggtgctggaaactgttctttggatgttattcaccaagagggggataatataactaccgagcctgcaaaatggaagcccttggatggtttttcctataaagccggggagcccaataatagtgctaatcttcaggctttccgccgttgggattatgggggcattgttggaatgaaggctgttattgccgatcattatacgataagttttgattatagggtcggaataaaaaagatacaggcacaaaatggtttgcggaattcaactttccagttctctgtgggctatcgtttctaaactgatttaattaaactggcaatctgtcaaaatgataatgccggtgtatgagggtgtcctgtttcaaaggatacagtttgtgtattttcatcgtattctcgtgcatcggcattttgacagattgtcttctttttctggttatttattcttttatggatatatgtgaacgtatatgtagggaaatgcatacatacgtgtccgacagggatctttatgccttttgagacccctctatttattgagccagctctttcaatatctcctctattttctgaaagagttgtcctatgtgcgctccgtccacaaaagcatggtttacagtgaaagcgatgggcattaccagtcttccttcgcgtggcactactttgccggcattcatcagcggatagtctaatggatggtcgggagccatttgtgtataggtgagtgaagtgaaataaagctgaggcgtggcactcagttggataatatcaaaatctccctgttctttaatgactttttcggctccatacgggtcaccctcttcggggatgttatggacgatgtgatatgcttcggcataaaaccgttcaaaatctgcatggtaagggatgcggactgtgtagaaagtcttgccgggtacagcgataggtgatatgatgtccacctgatcgtgatagaccacctgtccgtttttatctgtacggaaacggaattctttcacttcattggcagcacgtagcacagcatacaggtaatacaggaaaaaagagcgcttggcggcttttgcagctggaaatgcttcagtgcaatccacttcactggtaatggatatccatgaattatggaagttgcggaaaaaattataattgtcccggcgttcccaagtttcaatatctattatatgtttcatttattttacgggtttaaaagaatggtacatgaagtgcgctcccagcagtatgaacggaatgctgagccattgccccatgttcagcatcatactgtcttcaaaggcttcctggctggcttttataaactccacaaggaagcggaaggtgaatatggtagtgaggcagtagccgaaatagaaaccggggtatagcgtggttttgtactttttatacaaccgcaagcctatgataaaaatcagaagataggcgatggcttcgtagagttgtgccgggtggcggggttgcatatcttcgtgcggaaaaatgaacgcccaaggaacatgagttaccgtacctactatttcaccattcatcaggttacctaaacggataaaacaacctgccagcggggtggcgatggctatattgtctagtacagtcaggaacttcaattttacacggcgtgaatagatccataaggcgagcattagtccgatggttcctccatggctggcaagaccttgataaccggtccattttatcccagaatcggtaatcttgacgggcaacagcatttctacagggtgagagagccaatagcctggttcatagaacagacaatgtcccaggcgagcaccgataacaatacccagcaggcagtaaacgaacagggaatcaaatttttcgtaaggaattttttggtcttggtagagtttgtatatcacccagtaggccaatgaaagccctgtaacgaacaatacggagtaataacggatggaaatgccgaaaatggaaaagatttctatatcgggattccaaagaatggctgacagtgtattcatatcttgaatttttgtgcaactttgcggtaagtgggcatatccacatccatcttttcgcccagtgcgatcatatcaaacaatagtccttgtatttcggactcatgtcctttggctatatctttttgcatggatgcggtactgtccgggtctaatttgtcaatcacttttaagttgtattctatcgggtcttccgcataggtaattcccattttgcggcctatttcagaactttccttggacagaccgatgaaagtgtcgcgttctgctccgggatgttgcagaggacccattgggacatcatggtaggcacctgtgcaggccatagccgagatgaatgaccatttgatgaaggtgtcgcgattgatatcatccgaaatatcggctttgatccctgcttttcttagtacatcggcaatggtttccagacgttccggagccacaccctgttggggacgtgcgccgaaaaccagtcggaatattttgcccatttgtgtgatttcacccggtccggagacgaaacctacgatgtagatgcatccgtctagtactgttacatgtgaaacaagttgcccgatacggggacctgtaccgtaaacattcaggatggggataatcaaggtatctttatccgaggctttttccaacagatctttgatggaatctagggagtagccctttacgcatacaaaaattacgttggctttctcgttgtattcctcggctgtgcaggcttgtacaggcagaaagtgattacctttcaagtctgatcttaggtgaagtcctttttcacgaatggcttccagatgcttgccacgggcaatgcatgttacatcttttcctgctaaagcaaggaaaccggcgatgcttcctccaacgccgccggttcccacgattaaatatttttccatgttagttgtattttgttttaggaaacaaaacactgacttatcagtctgccattagttttgctggttccctgatgttttttcattcatagcatggctgtgataagtcttttgcgttttgatttacctacggtttatacattgaagcggaagtgcatgatgtcaccgtcctgcactacgtattctttaccttccacgcccatttttccagcctctttcacggcggcttccgaaccatatttaatgtagtcctcgtacttgatcacctcggcgcggataaatcctttctcgaaatcggtgtggatgacccctgcgcattggggtgctttccatcctttgcggtaggtccaggcttttacctccatttctccggcggtgatgaaggtttccagttccagcaggtggtaagccgatttgatcagacgatttacacctgattcttccagaccgacttcctgaaggaacatttggcggtcttcataggtttcgagttctgcgatatcggcttcggttttggcggctacgactagaatttctgcattctcttcttttacggcttcgcgtacttgttctacatatttattgccggtagcagcgcttgcttcgtccacgttgcatacgtacatcactggtttgctggttagcaagaacagttcttttgcgattttctgttcgtctttgctgtcaaattgtacggtacgcgcagatttgccttgttccaatgcgtctttgtatttaacaaggatgtcgtacatttgtttagcttgtttgtcaccgcccgtctgtgcctgtttttgtactttttggatacggctttcaatggtttccaaatctttcagctggagttcggtgtcaatgatttctttgtcacggaccggatctacactaccgtctacatgagtcacattttcatcatcaaaacagcggagtacgtgcagaatagcatctgtttcacggatatttgccagaaacttgtttcccaacccttcacctttgctagctccttttacaagtcctgcaatgtcaacaatttctacagtagtgggaacgatacgtcccggatgaaccagttcggcaagtttggtcaggcgttcatcaggaacggtgatgacacctacattcggttcgatggtacagaaagggaagttggctgcttgagcctttgcattcgataaacaattaaaaagtgtcgactttcctacgtttggaagaccgacaatgccacattgtaaagccattatctatttgtttttttgattattatctatctatttgtttgcaaagataaccattctttttgtatcaggcttcatattgaagtcagatttggcttttttatatgcgaaaagactgcccgtcacgaaacaaaaagggcaaccgtcacggttgccctttcgtagagtttttatgaaaagtgttagattgttagaatagatttatttgtccatagttacggtcatttcgggtactaatatatattctttctttttagagttccatttgtaatattcagtagtcatacttttgttgccataagtataacgaatgcagaggtcattttcccagcgatttttgttactgttccatttttgcgcctcgtcctctgtgcgttggttgttggcatcatacttgtaattgtgcttcatataattagtaagcatggtgccttccattttaaaaatcgtttccgaaacaattactccatttacttcttctgcattgtaaatcaggttgtcacccggatttcctgcaaaaactgtaaggttagcaataaataaaattgctacaacgagcattcctttcaaaaaattgatcttcttcatgatattgatatgttagattgttactttcatattgtttttaaaaacggtgcaaatgtacgaaagaaaattgaatctcctaacatttctgctaaaaaatgattatatttttgcaaaatgtcactgattaaacaaatattaataattgtataagatctatttattacaattatcttgtgtttgtgtttttcatttacgttcgggatggcaaatgaaaagctcaatggattggaaaagaccattgagcttttatgatataaataccttatatatagtactatatatcttgcgaatagttggtttctatatgctttaatgcgcttcaagccagttgcttccccaaccgcagtctgcgcgtaaaggtacttgcatatggtaggcattttccatctcttcaatcacaattttctgtactttttccttttcttcgggtagaacgctgaaatttaactcatcatgtacctgaagtatcattttggactttatattttcagattgaaagcgctggtatatgcgtaccatagctgccttgataatatcggctgcacttccctggataggagcattgatggcatttcgttcggcatatccgcgcacaaccgaatttctggaattgatatccggaagatatcgtttacggccgaatatggtttcaatatatccttgcctgcgggcaaggtcgatgcttttgtccatatattcctttatttggggataagtttcgaaatagccgtctattagttcttttgcctctttgcggtctacattcatacgttctgccagtccgaatacgctgatgccgtagatgataccgaaattagctgtttttgctttactgcgttgttcgcgggtaactttgtctatacttatcttatatacttttgctgcggtggcggcatgaatgtcatctccttccttgaaagcctctatcatattggcgtctccgctaaggtgtgccataatgcgtaactcaatctgtgaatagtcggcggagaaaaattcgcaaccatcatcgggaatgaaggccttacggatttccttgccgtcttcgttgcggatggggatgttctgaaggttcgggttgctggaactgagccggccggtagcagtgaccgtttgattgaacgaagtatgaattttacctgtttctttattaatcaataggggcagagcatcaatataagtaccgagaagcttcttcagaccgcggtgttccaatatcttgcctactatttcgtgtttccctcgcaggctttccaatacttcttcactggtgacatattgtccggttttggttttcttggctttctccacgatacgcagcttgtcaaacagcacttcacctacctgtttgggtgaggctatgttgaaatccgtacctgccagttggtgcacttcttcttctatttggttcatgcgggcggtgaaatgttccgaggtctgttttaaggcttcagtgtctacacgcacgccgttgcgttctatataagcaagtacggggaccaggggcatttctatttcgtagaagagtttttccgcatcgttggttttcaattcctgttccaagatgtttttcaatttcagtgtgacatcagcatcctcgcacgcgtacttatagatagcttcgggggagagatcgcgcatattcttctgacctttgcctttgggaccaatcagttcttcgatgtggatagtctgataatgcaggtagatttcggcaaggtagtccatattgtggcgcaattccggttgtagtacataatgtgccaccatggtatcgaacaggggaccgcgcacttcagttccgtagttgcccaataccagcatatcgtattttatattttgtcctactttcaacgctccttctttttcgaaagccggccggaactcattaactattttttgcgcttcggtccgatcggcaggtacagggacataaaatgcttgattttcggcatagctgaagctcattcccacgagttctgcggtgatgggatcggttcctgttgtttccgtgtctagactgaaaatttcttttgtaagtaagttttgtaataattcagatcttttctcttctgtatcaatgagttgatagtcgtattttaaattatctaaacatgctagattcgaatatttctcactttccgtccctccgtcggtaaattctgcaaagagattgccttgaggggaagacggagaagcgggcgatttgccattcgaagccggttcaccgaaaagggagagttgtcccgaaccgtccggcatgtttccctgccgggcgcttccttccggtgtgcggtttcgtccttgcagatcgtttccggtcgcatcggtgtatgttccggcgaaggcggatttcttgtttcggttgaaaacgcggtcgatgagggtacggaactccatctcttcaaaaatcttccgtagttcctcttcatttggttcttctcttttcagttcgtccatgttcaatgtgatggggacatcaattttgatagttgccagaaacttggagaactcaatcattttccggttggcttccactttggttttcaaggctcctttcagttcggcagagtgggagagaagattctcgatgctgccatattgcgcgattaacttttgtgctgttttctcgcccactcccggacaaccgggaatgttgtcggaactatcgcccatcagtcccagcatatcaatgacttgtgcgggtgactggatatcgaactttgcctttacctcttctatgcccatcacttcaaaaccgcctgtatgcttgggacggtacatgaagacatttccgcccaccagttgaccatagtctttgtctggtgtcatcatataagtagtgatccctcgtttgccggcttcggtggccagtgtaccgatcacgtcgtcagcctcgtatcccggtatttccagaataggaatacgataggcccggataatatcctttataatgggtacggacaaacggattacttcgggtgtttcttcacgttgtgccttatactgttcataggcctcgtgccggaaggtgggaccggcgggatcaaatgccacaccgatgtgcgtaggattttctttcttcaagacctcttccagtgtattgacaaatcccagtacggctgaagtgttgaaacccttggagttaatgcgcgggcttttgatgaaagcgtaatacgcgcggtatattaatgcataagcatctaatagaaaaagtttgtccattcttaaaaatctttagttttttcattgtaaaagtacaaaaaaataccgtattccgtcttttattactacttttgtgcacaaattaacctgcatggacaaattacagcaaatcaaattgcctattgacaaggagtttgaggaatttagaaggttgtttgactcttcgctccaaagttccaattctttacttagtgaggtgttatcctatattaagcagagaaatggcaagatgatgcgtcccatattggcgttgttgattgctaaactattcggtgaaatcaatgattctacgcttcatgcggccctttcattggagttgctccatacggccagcctggtgcacgatgatgtggtggatgagagtgacaagcgccgtgggcagtcttcggtaaatgctatctataataataaggtgtcggttctggtaggcgactatatgctggcaaccagcctgaagcattctgccatgacccgcgagattacaattgtagatttggtggcttgtttgggacagaacttatctgaaggcgagattattcaattggcgaatattaatgcttctgagttctcggaagaagtgtattatgatgtcattcgtaaaaagacggctgcattgtttactgccagtgcggaagcgggggctatttcggttcatgcatccgatgaaatggtgaaaaatgctcgtctgtttggcgaaatgattggtattgctttccagataaaggatgatatctttgactattattcttctgatgagataggtaaacctaccggaaacgatatgcgtgaagggaagctgacattgccggctttgtatgtgttaaatacgtttgatgatgaggagatgcggaaactggcgttatgtatccggtcattagacgcttcggatgaagatattgcccgtttcatcgaatatactaaggtgaagggagggatagagtatgccagacaggcaatggtggattatcgtaataaagcgttggctttacttccacaatcagccggtcaagctgtaaaagatgctttgactgcttatattgattatgtgattgaaagagataaatagtacgattgttgaagatatgtacctcaaaaagttcgggcgtgatcctttatacgataaggaccacgcccgagctttttgaggtacgcctttctttggtagtttaaaataaccggaatagataaggctcattccggtcactttaaatgtggttgttatttaaatagtgaaacggttctttgtttagaagaacttggtttcctgacctacaatttctgagagaagcagattggccaggcggcttgttcctaagcggaatagctcgtttgtcagccattcttcacctaacacttcttttacaatggtatagtaaaccaaagcatcgtgtacggtattaattcctccggcgggtttgaatcctactttgcggcctgttgtcatatagtattctttgatagcctcgcacatcaccaaggcggcttcaggagtagcggcggggttttcctttccggtagaggtcttgatgaaatcggctccggaatacatcgatagaatggacgcttttttgatgttggatgcgcttcccagtgctccagtttctagaattactttcaggtggtgctcaccacatacagcttttaattcttctatttcatcgcacattccttcgtaatccccactcaggaacttgcctaccgggataacgatatctatttcatcagctccggtatggagagccatggctgtttcggctacctttacttcagtaaatgtttgtgatgaagggaaaccacccgatacacaggctatgtttacatggtctgcctccaaggtgtcgttgactacttctgccatattaggatatacacagattgcggctacattgtccagatcagggtacttgtcaacaaattcatttacttttccggtgaatttcattacactttcatccgaatcagtgcactttaaagtggtcaggtcaatgcaatggaacaggaatttctttacgtccggtgtattgttttctgctacatgtttttcgatgagtagggcagttttcgcttttacatcctcatcgcgcaaacggatgttatacttggcaagtgcttcctcgtacttactgtgctcgggtccatgatcgtggtcatgacgatgttcatgtccaccttcgaattcgtgattatgttccataattctttataatttggggttgtttttatgtctgtctttatctctatttgttttcttctccaagttttgacggaaggcttcggtcaggtttactccggtctggttggccagacagataaggacccacaatacgtctgccatttcatcggcaaggttgtctttctctccttgtttgaaagattggtctccatatttacgtgccatcacacgtgccagttcgcctacttcctcggtcaggacggtcatattggtcagttcgctgaagtagcgtacaccgtacgttttaatccagctgtccacctctttttgtgcttcttccagtgtcattattctttgtttttagtgtccatacatatagtaacaggcccgttgttcagaagttcaactttcatgtctgctccgaattctccggttcctacttctttgcctaaaccgatgcttagttcccggcagaaataatcgtagagaggaatggctatatcgtgttttgcggcacggatgtaggagggacggttccctttctttgtagatgcgtgcaatgtgaactggctgataaccagaatgttgccttctacctcccgaatggatttattcatcactccgttttcatcgtcaaagactctcaatcctattatctttttgcataaccagtcagcatcttcttgtgtatcagcttcttcgataccaaccaatatcatgaatccttcttttatcgccgatttgcatacaccttctatggtaacagaggcgtggcttactcgttgaataactactctcatatttatatcctttatttattattagaaaatgcttgccgtttaccggtattatgtccgcctactatggtgggtggaaacattgccgacctcttggcttgacagttatgagggcggcatatccttgcaatggatgtatgcaaaggtaggaaatcccttttattctgtgaggttttctttgatatttttagcggctgcttcacctaccacggctgcaatctcttccagtgaggcttgcttgatgcggctgacgcttttgaatgttttcagcagggcggtctttcttttctcacctattcctttgatgttgtctaaagcggatgccacctggctcttgctgcgcttgtcccgatggaaggtgatggcgaagcggtgtacttcgttctgtatattctccaacagatggaacaagggagtgctttgttttacaccgatggtcagcggaggaaaaccgtatagcaattccgaggtgcggtgcttgcggtctttggccagtccggctatggggatatccaaatgaagttcgtcttctatcacttctctcactacttccatttgcccctttccaccgtcggtaatgatgaggtcgggcaggggggaaccttcctctatggcgcggctataccggcggcgtaccacctctttcatagaggcgtaatcgtcgggcccggtcactgtcttgatgatgtatttccggtaatccttcttgcttggttttgcctttttgaagactacacaggcggccactgcgtccgaaccctgaatgttggagttgtcgaaacattcaatgtggttcggcatcttcttcatatgtagctgctcttggatttctttcatcagacggacgcttctttgttctggatttaacttttccgcctgtttcaaacggtctactttatactgcttcacgttcattacggagaggtccagcaaatgcttcttttctcctcgttggggaacgataaaggatacattgttcatctccatatccagttcaaaaggtacgatgatttcgcgggaagtgctcttatatcgttcacgcatctcaataatgcccaattgtagaagttcttctttcgtttcgttcagacgtttcttgtattcgaaggtgaaggcttggttgatgcatccgttagtgatatgcagatagttgatataggctgaattttcttccatttcaatggagaatacatccacattatggatgatggagttgaccacttcgctcttggagcgatagttttctatcaagtcgtatttctcttttattttctgtgcttcctcaaatttcatttcggcggcaagcgcttgcatttcctccatcagcaggtcacttacaatttgtgtatctcctttcaggatatctttgatttcaccgatattcttcatgtattcctcatgcgattgttgtccgatacatggccctttacaattttttatatggtattccaggcacacgttgaacttgccggcacgaatgttctctggactcaggttgagtttgcaagtgcggatgggatagagcttttttatcaagtccatcacggcaagcatggagggcatgtggctgtacggaccatagtaggaggagccgttacggatgattttccgggtcttgaagatgcgtggaaaatactcattgcttacacaaatggaagggtaggtcttatcatctttcagcaatacgttgtagcgcggtttgtatttctttatcagattattctctaacaaaagggcgtcttcctctgtctttaccacgatataacggatgtctgcaatcttgctgaccagcaggcgtgtcttgccgttggggtgctctctgttgaagtaagaagagactcttcgtttcaagttttttgcttttccaacgtagataatggttccttcggagtttaggtattggtaaatgcccgggctgtcgggcaggtttagtacgattcctttcagatagtcattggttgtaatctcttctttttccataagtgtatattggtattacctgattatatgttaatgtaagctcgatataaaaatacctcgttgctgaattttgagttaaatgacaaacgattgttttccggacaaatgagcgcttccgtaggggcggccccatgtgtccgcccctacggtggaaacatctcaaaatagcatttcgtggtatgattgtgggtaatcatcttataaatcttcaagctgtaagatatataatgttacagcttgaagatatatatctttcggcttcatcgtccatatcttttcgttgtccatccattgttgtctttctatagtgactcgggacggacttcgcttttttacgggcagattgtgcggcgttataaagtaagcagtgtatccactgtgatgtcttcggggaatgcctttctgccgttcagacctcccaactcgataatgaagttgatgaagatctttttggcaccacatctttgtactaaccgatgagtggccgccatggttccaccggtagccaataaatcatcgtgcagcagaactacatcgttttcattgatggcatccttatgtatttgaatggtatcggttccgtactctttagcatacgtttcttctacaacctctgcagggagtttgcccggcttacgcgccattacgaatccggctcctaaacgtgccgccagagcaccgcccataatgaagccgcgcgactctatacctactactttggtgatacctttgtccttgtacatttcatataaagtgtccagcatttcctgcaagcactcggcattcttaaacaaggttgtcacatcataaaacagaattcccggaatggggaaatctggaatttctcttaagtttgctttaagcgtttctttgctcataaccagtgttttattgttagtctattaaattacttgtttcacgtgaaacataccttgtttcaccgccccagcagaactagtaggacgttgatgtcgctaggagagatacccggtatgcggctggcttgggccaatgtttcgggatctatcttcatcagtttctgccgggcttcggtagagagcgaattcaatgagttgtagtcgaacttgcctttgatgcggatggcttccaagcgatgtatcttttctgcgattattcgctcgcggtcaatatatccctgatatttgatcagtacttcggcggcttcaatcacttcttctttacggtcggtaatttggtccaacatggctttgaaagccggaatgtgcccggctatattttcgatggtaatctgcggacggttcagcaggtcgattagtttgcagccgtgtgtcagacgggcagtacccaaactttccaaagcatcattgattaatgcggctttgatagagaaggtcttggcaaagtcgatgatttggttcacggcttcccgtttgctgcaaagatgttcgtaacggtcttgttttaccagacctagtttgtaggcacgttcagtgaggcgcatatctgcatcgtcttgtcggagcaggatgcggtattcggcacgggaggtgaacatacgataaggttcgtccacaccttttgtaaccagatcgtcaatcaagacaccgatgtaggcctcgtcccgtcccagtgtgaacggctcgccaccgtggcagttgatgtgtgcgttgataccggcaatgattccctgtccgcctgcttcttcgtaaccggtggttccgtttacttgtccggcaaggaacaggttctttattattttcgattccaacgtatgtttcagttgggtagggtcgaagtaatcgtattcgatagcgtatcccggacgataaactaccaagtccttaaatgcaggtactttcttcaatgccgccaactgtatgtccatgggcagtgaagaagagaacccgttcaggtaaagttcttgtgtggtttctccttcgggttccaggaaaagctgatgttgcggcttgtcggggaaggttacgattttggtttctatgctgggacaataacgcggtccgatgctttggatttgtccgttgaaaaggggagagtcgggcagacctttgcgcagtacctcgtgcacctcttcgttggtaaagcaggtccagcattgcagttgtttcagcttgcgcggttcgctcatgaacgaaaagcggtggaagtcgttttctccgtcctgtgtttccatcagctcatagtgtacgctgcgtccgtctatgcggacaggtgtaccggtcttcatacgtccggcgttgattccgtggcgggtgattgattcggtcagatggtaggaggcaggttcggccatgcgtcctcctgccagttgtttatgcccgatgtgcatcagtccgttcaggaaggttcctgcggtgagcacgatacattttgcatggaaagtcactccccagcaagtcatgactccggtcgcttcaccgttttccacgattagttcttctacagtatcttgccaaatgtgcagattgggagtgttctccagaatctcgcgccatgcccagataaacttgccacggtcacactgggcacgggggctccacatagcgggacctttggaacggttgagcatacggaactgtatggctgtacggtctgtaaccagtcccatatagccacctaatgcgtctatctctcttacgatttgtcccttggcaattccacctacggcagggttacaactcatttgcccgattttgttcatatccatggtaatcaggcaggtcttcgaacccatgttggctgcggccgcagctgcctcacagcctgcgtgtccggcgcctattacaataacgtcgtacttaaaatccattgatttatttctttttaccgattgcaaaattacgaattttactctgtaaagcggtgataatacggctaaaaagaatgtgtggcgacagaaatctgcttctgccgccacatcatacaaacactatttctaaagtaaactatttcctgttatttcttgtccggagcaggaggggtgtcggacgggcgtttctttccgtccttgtctaccggtttaaactcctctttctccggttcattctgtgcgttttctttcgaggaaggattgacaatgttctgataggtatcatgaatgggaagcttgtctaggatacccagtgcaggagctactttgctgacgacgttctgcaagaaattagatgtcgtgccgttgccgccgtcaaaaacagtaatattccccagttgaatatgttcaaatgccttaacctgttccgaagcgatttccttccattggtcaaccatcttgtattggatggcgatttcgggattgcgttcggcagctttcaccatggcctcgaagccttctgcttcggccagcaaggacttcttcttaccttccgcttctgcctccagcttcatctggatggccttggcttccgcctgtgcttttgccaggatagcttccgcttctgcatttgccttacgttttatttgctcagccaatgcgtccgcatccaagatagcttgctgtttggctatttcggcaggaacaatcttatccgcttttaaggcctgttctactttgcgggctttcgcttcttctatctcacgctgtgcgttttcctgtgcagtgaggacagcagcttgcgttctggcctgtgcttcaccagcctttctagaggcttccgccttggtaacttccagctccgcattactttcggcaacctctttggcagcgttattttgcccgatggccgatttcttttgtgcttccgcctgctttatctccatatcggactggagctctgcagtacgactctcctgttcggtacgcgcctgttccttgttcacttccatagaggcgctggctttggcgatacgtgattctttttcggcgttttcttccgctactttcgattcacgttccttgtcggctatggctactttaatctcctcgtcacgttgcgtatcggccagttgagtgttcttgtcgcggttggtttccgctactttggtggcgcgctctttttgctgttctgcaatcttgatggcccccagtttctgctgttcttcaatgttggctaaggcttcattcttggctttcgcttcggcttcttttcccagattgacgatatagtcagcttcatcacggatgtcgctgatgttgatgttcatcaggtaaaggccgaatttcttcaattcggagtcgatgttcttgcggcagttttcaaggaatgtatcacggtcgctgttcagttgttcgatagtcatatcggcgatgaccagacgcatttgtccgtaaacaacgtctttaatcagttcctgttgtgcctcgatgttcagtcccagcaagcgttcggccgcattctgcatgacttcgggctctgtgcttacggccacagtgatggtagtgggcacatctacgcggatgttttgtttggagatggcgccggtcagtttgcagtcaatctgcatgggtttcatgttcaggaaagagtatccctggatgatgggccatacaaaagcggctcctccgtgatacagtttagccgatttcttatcgccggtcttaccatatactaccaatacctcgtcgctcttgcacttgcggtaacgacttaaaatcccgacgatggtcaggacgatgacagctaccagaatagctgcataaatgagaatctgctcatccataaatgattgcgtttttagggtttatttaatcaatataatagattccttccttgtaatccttcagtgtgaggatatcgccttcctgatagcttttaccctgtatgctccgcacggtaagttctctttgtgcaccattgatggcgatatagaccacgtattctgttcctgcctgtccttgttcctgacagcgggtatatatttcgcatttcctgcctattaattcttctccctgttcgggcttattttcttgtttcagcttatagcagagtttataaatccaagctaggacgaaaacaaaaaagctgccgcttatcacggcgcccagataatgcaagacaatgtagggaggctggcataaatacatgaaccaaccgaaacccatgcagaaatgaatcagccctttgaaggagagtacgctgctcatgtctatatcggcgttgccgtcggcattgacgtctatgtcggtgtccatattgccgaaaaagatggataagatgaattgcagaagaaagattcccgtacttactaatgcagcgaaaaaatatacgttagcttccatttgagtgatatattttgtgtttatctgttttttcaattcacaaaataaagcaattaatccggaaaagcaagaagataagggaataaatgtagctgcatgtatagctttcgacgtttttatccgtccggcggaaagttttccctaactattggcatgtctttgaaaagttacgggcaatcattcgtgcgaactatgcccgtaacttttataggttgttctaccttgtatgtcctgttatagggaaaccaatgccagcgccttgttctcggcagcttccataatctcccgttcaccgggccctttgtcgttgatgccgcacaagtgcaggataccatgaataatcacccggtgaagctcgcggtcgtagggttgctcaaactgttccgcattggtgcggacagtatccagactgatgaataaatcaccggaaatgcgattaccttcgcaatagtcgaaagtgatgatatccgtgtaataatcatgttgcagatactgctggtttacttccagtattttatcgtccgagcagaagatataagcgatttctcccactctttttccatagcaggcggctacctctttaatccattcggtggtttctttctttttgatatcgggcatctttaccccatcggtttgataacttatcatagaataacaaattagaaatgacaggcaaagataggtaaagtatcttgttagcggttcactttcgggatattttctaataactttctaatctggtctgagttgattataatcggtttcacttctcatcgggaaaagggcgttgtacttttgtcacccaaaaacagaaaacaatgaaacaacgtgctattcttttcttttttataggcataatgacaggaatactgcaggcacagaccttgactctgaaagatgccggacagctttttctgaagcagaacctgtctcttattgcagcccggtatgatatggacattgctcaggcacaggtattgcaggccagactttttgagaatcccgttatctcgttagagcaaaatgtgtacaataggctgaatggaaaatactttgacatgggaaaggacggggagtcaggagtggagatagagcaggttatcagtattgccgggcagcgtagtaaccgtatccgtctggaaaaagtgaacaaggaaatggccggatatcagtttcaggaaatcatgcgcaccttgcatagtgagctgaacgaacgatttgtcgagacttattttctgactagaaatatggctgtttatgaaaaagaaataacttcgttggagcgccttctggctgagatgaaacttcaacaacagaaaggaaacatttcactgatggaagcctcgcgtctggaggccatgttgctttcattgaagaaggaaaggaatgagcaggagaatcagctggttgccgcccggggagaattgaaccttcttctgagccttcctgctgatgcgcgtcctgaactgctactggatgaaagtatgttgaaacagctggacttgtcacaactctcttatgcggacttgatggcacgtatgactggacgtcccgatttaaaactggcccgtacctatatccgtgcttcgcaggcgaaccttaaacttcagaagtcgctggcttttcccgaagtatcctttaaagggacttatgaccgtgccggtaattttatcaataattactttgctgtggggatcagtttctctgttcctatatttaaccgtaatcagggtaatataaagtcggcccgcatcgaaatcatgaaagcggataaggaaaaggagtatgccatgggaaaagcggagatggagctttttaccgcttattcgcagctggagaaggcgatgaatctttatcagtcggtggatagtgatttggagcagaactttgagaaactgatagcgggagtgaatgaaacgttccggaaacgtagtatcagtctgttggaatttatagactattatgagagttataaagaaacttgtatacagttatatgacacacgtaaggacttgcttctggctatggagaatttgaaccgcgttatcggacaaaatgtatttaattattaataacttatcaatcagagaacaacaatgaatcagaatatctttttactgggcttattttttcctcttctttgtaactgttcggcaccggctgaacaaacagacacgaccaatggggggatcttcctgacagacagtttgaaacaagtagtgaccattgatactgtaagtatacaggaggtcacgatggaacttaccctgaacggtcgtgttactttcaaccaagaacaggtggcacgggtgtatcccatattcggggggacggtgacggaagtccatgcggaaacgggagattatgtgcaaaaaggtgaggttctggccgtaatccgtagcggggaagtggccgactatgagaaacagcagaaagatgctgcccaacaagtgcttaccgcccggcgtgccatggatgcgactcaggacatgtatgtttcgggcatagcttcggagcgcgatatgctccaggcaaagcaagaactggccgcagccgaggcggaggataaaagggtgaaggaagttttctccatttatcatctgttgggtaattccttttatcaagtgaagtctccggtagcgggatttattgtcaataaaaacatcagcaaagatatgcagatacgttcagaccagagtgaggaattatttactgtatcggggttggagaatgtctgggtgatggccgatgtctatgaaagtgatatcagcaaagtatgtgcaggagacagggtggagattactacactggcttatcggaacaggagtttcggaggcactatagacaaagtgtatcaggtgctgaatgacgagagtaaaacgatgagcgtgcgcataaaattacaaaatagggattatctgctgaagccgggtatgtttaccaatgtaaaggtgacttgcaaggcatccgaggaacggatggcacggatagaccctcattcgctggtttttgagaatgggaagaattatgtggtagcggtagacggcgacggcagtcttcaggtgaaagaggtggagatttacaagcggtcggataaggaatgctatctccgttccggtgttaccggaggcgataagattcttaacaaaaatgttctgttggtttataatgctttgaatgacgattctaaatagaaggaaagtatgcataagtttattgataatatagtagctttttcactgaaaaataaattttttatatttttcagtaccacgatagcggtcattgcaggggcgatatctttcaaacatacacctgtagatgcttttcccgatgtgacgaacacgaaagtgaccataatcacccagtggccggggagaagtgcggaagaggtggagaaattcatcactatccctgttgaaatagcgatgaatcctgttcagaagaagactgatatccgttctaccactcttttcggtctgtctgttatcaatgtgatgtttgaggacgatgtcgatgatttcacagctcgccagcaggtgtataacttgttgaatgatgctgatttaccggaaggggtcactcctgaagtacagccgctttatggcccgacgggagagatttaccgctacactttgcgcagtggcaagcgtgatgtgcgcgaattgaaaacaattcaggactgggtgatagaccgcaatctccgtgctgtgccgggtgtggctgatattgtgagtttcggtggcgaggtaaagactttcgaagtcagtgtgaatccccatcaactgataaattacggtattacttcattggaactgtatgatgctattgcaaagagtaatatcaatgtcggaggagatgtgattactaagagctcacaggcctatgtggtgcgtggaatcggattaatcaatgatttggaggaaatccggaatattgtagtgaagaatatcaacggtacgcctgtattggtccgtcatttggcggatgtgcacgaatcctgtttgcccagactgggacaagtaggacgcatggaggaagatgatgtggtgcaaggcattatcgtcatgcggaaaggagaaaatccgggtgaggtgattgctgccttgaagcataaaatagcagaactgaatacagggattctgcccgaggatgtggagattgttccattctatgaccgtgagaacttagtcaatctggctgttcatacggtgactcataatcttattgagggtatattgttagttacgtttatcgttttaatttttatggcggattggcggacgacagtgattgtcggcatcgtgattccgttggcgctgctctttgcctttatctgccttagagcgatgggaatgtctgccaatctgctttctatgggagcgatagatttcggcatcatcattgatggcgccgtggtgatggtagaaggggtttttgtggcgctggacagaaaagcgtacgaggtgggaatgcctgcgttcaaccggatgtcgaaaatggggcttatccggagcactgccaaagataaggcgaaagcggtgttcttctccaaattgattattatcacagcgttggtgcctatattctcttttcagaaagtggaaggaaagatgttctctccgttggcatatacattgggattcgcactgctgggggctttgatcttcactttgacactggttcctgtcctgtcttctatgttgctgaaacgtgatgtccgtgagaggaataactgtatcgtccgttttatcaatgaaaaagcttcgttgctgttcgaccggtttcatgcccgtcgcagtctcactatcggactctctacggtggtggcggttttcggattgtggctttttactttcttgggaacggagtttcttcctcagctgaatgaaggttccatttatgtacgcgccacgcttccgcaaagcatcgctttggatgaatcggtggagctggccaacaccatgcgtcgtaaactgatggcttatcccgaagtgagacaagtgatgtcccaaaccggacgaccgaatgacggaacagatgcgaccggtttctataatattgaatttcatgtagacatctatcccgagaaagaatgggagagcaaactgaccaaattggaactgattgataagatgcagcaggatttatccatttatccgggcatcgacttcaacttctcacagcctatatcggataatgtggaggaggcggcatcgggggtaaagggctctattgcggtgaaagtgttcggcaaggacttatatgagtcacagaaacttgccgtacagattgataagattttggggactgtggaaggtattgaagatttgggagtaatccgtaacatcggccagcctgaactgcgtatcgaactggatgaacagaaactggcacgatacggggtagcgaaagaagatgtgcagtccatcatcgagatggctatcggcggaaaatcggcctctttactttatgaagatgaacggaagttcaatattatggtgcgttataatccggaattccgtcagaacgaagatcagataggcaagatattggttccggccagcgatggagccatgatacctgtcaaggaattggcggatatccgtaccattacaggacccttacttattttcagggacaaccacactcgtttctgtgcggtcaaattctccgtgcggggacgggacatgggaacggcggtggcagaggcacaaaagaaagtaaatgccgcgatccatcttcctgaaggatattctttgaaatggacgggagattttgagaaccagcaacgggcgtccaagcgtttggcccaggtggttcctgtgagtatcgctattatctttgtcattctgtttgtacttttttcgaatgccagagatgcaggactggtgctgctgaatgtaccttttgcagccgtgggaggtattgccgcattgttgctgacgggatttaatttctcaatttctgcggggatcggtttcattgctttattcggtatctgtattcagaatggggtgattatgatttcggatatcaagcataatctgcatacacggctatccttgccggatgcggtgaaaacaggaatgcgctcgcgtatccgttccattgtaatgacggcggccatggcggctatcgggttgatgcctgctgccatgagtcatggcataggttccgaatcacagcgcccgctagctattgttattattggcggtttgataggagccactttttttgccttgttcgtatttccgctgattgtggagtgggtttatagcaagatgttgtatgataaagaaggtaatctgctgcaaagaaaattataatgatgtatatttgcaaccgacagaaaaacagatttgtttatggcaaaaataatattggtagaggatgagataaatattgcctcgttcattgaaagagggcttcgtgagttcggtcacgaggtctctgtggtgtacgatggtaatgcgggatgggaactgcttcagaatgagtcttttgatttgttgatattggatatcattatgccgggtatgaacggattggaactgtgccgcatgtaccggcagcgtttcggctatcactctcctgttgttatgctgacggcgcttggaactacagacgatattgtgaaaggactggatgccggagcggatgattatctggtgaaaccgtttagctttcaggaactcgaggcgcgtatcaaggctttgctccgccggagtaaggaggttcctgtacagcaattggtttgtggggatttgattttggactgtacgttgcggcgtgctcgccggggaaacatggatattgatcttacggtaaaggaatatcggttattagagtattttttgttgcatcaaagggcggtgctttcccggcttacgctattacgtgatgtgtgggataagaattttgacaccaatacgaatgtagtggatgtatatgtgaattatttgcgcgccaaaatagataaaggttttgaggacaagttgatacatacagtggtgggtgtgggctatatgatgactgattgaaaagtatctttaggatatagagaaacttaaaagaaaggatagacatgaagattggacctaaaatagctttgttttattccctcattacgatgtgtgccattatcatggtgatgagcgtgttctatttgttcagctctcgctatatcaaccgtctgtatgagtcttatttgcgggagaaggcatttatcactgctcagaaatattgggaaaaagatgaagttgacgaacagagctatcggttaatccagcagaaatatgatgagctgctgccgcaagcaagggaagtattattgaatatggacacgttggcacacgtcaaggacacgttgggaaaatatctcaatgccagtcagcaggaaagactttttcatggtgacggtactccggtgacttttaaatataagaaagaattgggtgcggctctctattatccggataatgaaggatattttattgtctttgtcttctctgaaaacacttatggcaaggagatacaggagcatattttgctactttcggttactctcgttgtcatcagttctatttttattttttttatcgggcgtgtttattctaaccggattcttactcccctgcaacatatcttgaaagaattgaagcgtatccgcgccaataacctgaatgtacgtctgagaagctatgggaacaaggatgagctggatcagctgattgtgtcactgaatgggatgctggatcgtattgacacagcgtttaaatccgagaaatcatttgtcagcaacgcttcccatgaattgaacaacccgcttactgctattcagggggagtgcgaaatagcccttctgaaagagcgtagcacttcggaatatatggattctttggaacgtatctcggtagagagcaaacgtatttctctgctgataaagtctttgctgtttttatcccgtcaggataaggatattctagcaaatacggtagaggatgtttgcctgcctcggatgctgagggagcagtatgccggccgtcctcgtattcgtctgtcttccacacttagggaggagaatgactttattgtccgtgccaatccttatttattgggaatagcccttcagaatgtagtggataatgcctgtaaatattcggataaggatgtggaaatcagcttgttcgaaaaggagggccggaaagtggtggaaatcagggaccagggtattggtattcctcaagaagaggtagaattgatttttcaatctttctatcgtgctagtaatacacgttcttacaaggggcaaggcatcgggctaagcctttctttgaaaattatatctacttacggcggccaaatgggaatccattcggaagagggacattttaccaccgtaagtataacttttcctctgtccctagccgaagaataaataacagataagaatagccgcaatcactccggccaaatcggccagtagtccgcaaggaacggcgtggcgtgtcctcactactcctacgctaccgaaatatactgccaggatataaaaggtagtgtctgtggaaccttgaaagatacaggccagtctgcctacgaaagaatcgggaccgtatgtagtcatggcatccaccatcaatccgcgtgctccgcttccactcaatggtttcatcagtgctgtggggagtgctcctacgaaatcactgtcgataccgcatagctttacggctctgtcaatgccgtcaattaaatagtccatcgcacccgatgcacggaagacaccgatgcctaccagtatggctaccaggtaaggaatgatgcgtacggcagtgttgaatccttctttggccccttcaacaaaggagtcgtagacattgactttttttctgatccctgctacaatgaagccgatgatgataagaaatagaaagacattggcaaaggtagtggagtaaatatctatctggtttcgtgacaaggtattgaagaaataaataattcctgctaccagcaaactcattccccctaagaagaagaggatggtacggttaaacaggttgattctctgataaatgcttacagcgacaatacctgccaaggtagagaagaaggttgccagcaggatggggacaaatatgtctgtaggttgggcagcacctagttgagcgcgatataccatgatgctgataggaatcagagtcagccccgaagtattcagtaccaggaacataatcatgggattactggcagtatctttcttggggttcagttcttgcaggccctccattgctttcagtcctaagggagtggcggcattatctagtcccagcatattggctgccagattcataaagatgctacctgtcacaggatgtcctttggggatatcgggaaaaagtttactgaacagaggtcccagcaatcgggaaaacagagcgatgactccgccttgctcgcctattctcatgatacccagccaaagggaaaggacaccggtcagtcccagtgaaatttcaaatgcagttttggaagaactgaaagtagagttgataatttcgggaaacacttgtgtgtcgccaaggaaaacgagtcgcatcaacgctactacgaaggctatcagaaaaaaggctatccaaatgtagttcagaaccatatcgctagttttattagtaataactcggacaaaagtagtcaatttattcgtttttgaattagaaaagattcaattctcttatttttatttccaatctttgtttgaacacgatagcaaaatagtatgaaatgattttaagagcaaactactctctcatttgattatttcgatgaacgggacgagaaggaagcgtttaagcgattctcgcgagtttgaagaatatcaaaaagagtaaaaagacgtttgatggtttgctatttgtcgggtatataaagaaaaatgttctttatggatttaaatatgctttgaaatggatactaatgagatgtaaaataactcttgaaataagtctgttctagaagaaacggataatataagaatcgaaatagttaggaaaaagagttttgttgatcggatctgataataaaaggttatatttgtgcaaatatgtagtgtgaattctgtagtagaaggagggcattgacgtaataacaagtaatatgggagaatatatgatgaaaaccgaggaaataaagattagttcaagcagtttgaaagtatcgtttgtgattatcatggagtagagtgttggagtgcacgcgagttgtattccttattgggttatacccagtggagaaactttgaggctatcatcaataaagcgaaagctgcttgcacgaatgcaggtgaagatgtgacctatcattttgctgacgtcagcaaaatgataagtttacctaaaggtgcagaaagagagatagatgatatctatcttacccgttatgcctgttatttgactgctcaaaatggtgatgcgcgtaaaccggctatagcttttgctcaaaacaactttgctgttcagacaaggcgtgcagaattggtggaacaacatctgttggattatgagcgggttcaagcacggactaaattggctgaaacggaaaagctgttatcgggtgtgttttatgaacgcggagtagatagtaaaggttttgccattatccgttcaaaaggagataaagccttgtttcgtcttgacacagcgttgctaaaatgtaaacttggtgcgccccacagtcgtccgctggtcgatttcttaccaaccatcagctaaggcaaaagattttgctgctgagatgacttctattaacgtacaacaaaaagatctttatggacagtcatcaattgaaaaagaacatattgagaataatacggctgttcggaatatgatggggtaagccgaggaatctatccggaacaattgcctgcaggcgaagatttaaagaaagtagaacaccgtttgaaatcagaagaaaagaaaataactaagaaataatgaaggaaccgcttgaggagaaactataaatgagctgaaacggtttgctcactttcacatgcttcagtaaataattcttgtgatgtctggttaggcaaaatagaacttttagccatatactttttattattggcataaataaagagtacgcttcccccttttatcgtattgataataggtttggtcagtgcctgtggcaaagccggacaaccgaaactccgtcctaatctacccgatttgcaaacggatggattggcgtatgcggcgccatgaaccacaatggcacgttcacgggcccggtcatttatgcctttttccagcccgtctaataaaagagagtatccgtttttaccttgatatgtgtttccggtaagatagaagccgagggaacttttataagagccgacttcgttggagaaagaggtagcatagttctcgccgctgttttttccatgagagaccactgatgagtatagcatctttttctgttccatatcaaagacaaacaaacgtttttcggtagagggtttggtgaaatcaatcaatgtcagtatggatttgcttttttgtttaatcaagttgtatcctgccacagcctgtcggaatgccaggaaattgaccacccctcccaattgcatatcttcaaataattgttcgccgtccattttttgaggtgcagggacagatgtagcaactttcttttcgggtgtagccgtccgggtcgatacattgctcgacggaaagaggaataggaacaggagtaaaaaagttttttgcatgcgtatggaaaaactggataacgggtgcaaagttacgcacatttctattccaaaacaaatataatcgtctcattaacaggtgcccattcgaaaataaacttggcatgagaggtggcatttcttacacacatatgtgagcgggggatggtacccaacgtataactgtattctatgatccctgttgccggcgcattggtgggcactccgtggatataaccaccattattgaaacgactggcgtaaggtgcaaaaccaccggtggcggcagaaccgtcttttagaaaaatcattttagtctttttctcttgtagaacgaacatacccaatggagtttcttgggcgtatggaggacgatgttgtcctgttgtagcaggattcatgctacgtatcagccagcagcccttttctttccgttccaaagtagttatattctgattatggcggtctataaaaatagctttgttgaacactacgctgtcgggaatcagttttatatattttgccggagcataccattcaccacctataaagacaggttctactttggtaaattttccttcctcacctaggtgacgggtaagaagtccatctagtccgtagcgtttggcagtaagggtgtcatctgttaggaaaagaggaattccctgatagcgttccactcccaatgtgtcggctatccgtttgtatgcgtctcttttaaaatttttcactaaaggtgcttctccgttccggtttttataattctgtaagatacaccattgtgtcggctttctctggatgttctccaacagcgccagtcgttcctttattttttcccattggaaatgacgggtggtgtctttataaggataggtatcctccaaagtatgtttatcatacagcagttccttgtcaagcctgatgtcttcgggtttgatatctttttctacaatttcggcaatggcttctgtcacagtattgtgtacctctgttatcacttccttaatttcactatttgctttcgaggtacatgagcagattgtacagaaaccagtcaataaatatatgaattctattcttttcatcatagacacaggtttatggctttcttctacaaatataattctttaaaaggaataaacatgcgtttttgtttttaaatgcagtgaaaaattcctgtttctttgaacaatctcccctattgcagaccttataaaagaccgctgggaataatcgcttatcttggcttgaggtttttacagaaaaaaagaatcaacttaaaaacaagtattatggtggaatcaactagagtaagaagtaaaagattatccttttcaggtaagaagacactgtcttcctttatgcaagtgaatattgccagtctgagacaatcgggaaaattgcgtaccagtgagacgtatagagctacactgaacagttttatgaaatttatggatggcaaggatgttctgttgagcaatatggatgccgagttgatgatggggtatgaaacttatttaaaggcgcagggagcaagtatgaacaccgtttctttttatatgcgtattttgcgtgcaacgtataatcgtgcagtagataaaggggtgatcagacagcgttttccttttaagcatgtctatacgggagtggaaaaaacggtgaagcgggctatttcttttaaagtaatcagacaactgaaggagatggatttaagtcactctcagtcaatggagtttgcgcgtgatatgtttatgttcagtttttatactcggggaatgtcatttgtggacatggcttttcttaaaaaaacagatttaaataatggtatgctgacttataggagaaagaaaaccggtcagttgctttccatcagatgggagaaatgtatgcaggatatagtggataaatatcctggaaacttctcgacttatcttcttcctattataattcatatcagaaaagatgaaagattacaatataaaaattccatctgcttggtaaacagaaggctaaaagaaataggaaaaaagttagggcttgttcatcctctgactatgtatgtggcgcgccattcatgggccagtgttgccagaggcaaacatattcctctttctgtaataagtgaaggaatgggacatgattcggaaaaaacgactttgatttatctggcagcattggataccaccgtgatagacaaagcgaatatggtggtgctgagagaattcttgtgataatagggtaaagatattgtttcttgtcaaaaagaggatatcatatcacagggtatcctccatttgacgggaccagtgtgtccagtgttttttcaataaattagtgtttgttctttctaaagatgatagcaatttctgatgtggctgagttgaatatgcttgttgcaaggtcggaacagcatgatctctttatgttatcttttgtcagaagatgctgttatagtaaaggaaaatcggattacagatagatcctgaaagaattgccataaaccatcatgctgttttcgtccacccatttgttgtgaaaaaaatatcagttcccaaatattcaggatttttccgtaatatgatgattgtcataggtttgtttttatatgaattatagttgatacaactatattttagtggataaacttgaataaaagaaaaggcaaagtttacctagattttattctttgattttggagataatcctcttattacaagtactttatacaaaaaacaccaagttaaaatattgtatatctcttattaagagatatatattttgtcgcaaatttaagcaaagttttgagaattagaacaatttagcgaggaaatttaataattgattcaaaaaaaacgttttttgaatacaagatttagtcttctgaagtattcttatattaatatagttcgttgatttatagtgtattatgtgtgcgtaacatatctcttaataagagatctatcgtataactgatgacatgctatataataatgtatagttgtgaagatgttgaagtgaagattaaaagtaaataaaaatatggactatctattcttgagacgacacagacggactgctacttcgaagaggcagaaaaacctgcttcttaaggctgctgaacgccagtgggaactacagttcgccaacaagggggctgaagggagaaaggtggattgtaccctatataaatgtatattgtacaaccttgaaataaagcaagtctttttggattcggagctttctttgaaaaagtttagcgtaatgatagacaccaaccaaacttacctatcgaatgtggtaaacaagtatttcaactgcaatttgaaggagttgttgaatacctaccgtgtggaatatgctaaagagttactccatgctgggaaatgttcattagaggaactcccacagcgatgtggttttgcctctagaagtgctttttatgcctcttttagtaaaatagtcggaatgtctcctttgcgctttctagctcgtgaacagaataattcgctcttagaatcaatgatttatgtataatcaattttagttttttaaatttataaatttaaagtttttctattatgaacaaaaagtttttaagtgcaatcctgttcggtgccttaatggtgacctcgacaggaacatttgtatcttgtaaggactatgatgatgacatcgacagcttaaacgagaaagtggataagctgactaaagatttgtctgaattacaggccgcagctggaaaatatgtcacagctgtcaagtatgatgcggcaacaggtaagttgactgttaccggcggtaacggtgaaactttccaacttccgatgcctgctgaacttcccacttactctttgaaagttgtagatggtaagatacagttgttagatggtgacaaggtcgtttctgaagcaaccctgcctacaactgatgttcctgcgacatttgatcctactttgttgaagtggaacaatggctatctgtattatggagatgtaaaaatctcaggtgtagagaaacctcaaagcgttggttctattacagaagtgaaagatgaagaaactggtgaggtgattggttatgtcattgaactagatggcaaatctgctacattctctgtcgtaactgatttgaaagctttggtatttgaaccggaactgtactatcagggtattgaagcaattgctgtaaaatcatttgtttacaaggctttgactgctacagatgtaaatgcagatgctgataataaagatgatgctcctgtaaaagaaactgtaacaactgaggtcactcctgaattatctgctacataccacatgaacccatctacagctgatgttcgtaatttggttaaagaagatttgaaattcttggcttacgataaagaatatgctcgtgctgccgatggagtggtagttccagagatttctaaggttgaacctaaaaatggtgagttgactgtttgggctaagttgactgaaggaactattaaagatattgcgaatgacaacaaagtaacagttttggctttacaggccaattatttgaatggtgataacaaacgctcggttatcacttctgattatgctgcagttaaggctgttaagattacagatttagttttgaataatgcaaaagttgccggtgaaaatcatttggctgttaaagctgccgatgctatccaaaatgctcctgaagtaaaagtagcttgggatgaaacagttgatttggcagaatatgttcagactcattatggtgcaggtgatgctcatactaagtgggatgaaaatgcagcgtctggtacagtagaaaaagccggcttcagctattcttatgaattggtaggttatattgatggtagtaacaaaacttctcaaagtgcacatgccgcattgaaaggctctgttttgagacctcagttgccgaaagatggtaaagctgctgaatggggagctacagaacaaaatcaagctactgtagggcgtatgccgttggttcgtgtattcttgaatgataataactctaagaagaaagtagctgtaggttacttgaaggtggaaattacaggtgctcctgctgaagaccgtattactgcgacaacagaatatacattcaatgaagaatttacattgagctgtagaacagaggattgggttcaggaggtaacttggttccagattgaagaacaaattttggctcagctgaatatctctaaggaagatttcgaaagaagttatatctatgacggaccgatgattcaatatagtgaagcaactttggatgctatgcctttgactaaactgtctactaaggttgaacaaactgaggctgatgttgaaggtacaatgactgaagttttgcaatggactattcctgcaaactatgcttatgaatatttcagtgcaaatgcttcaatgaaggctattgttcgttacaccaaagagaacaaagacattcagggcaatgttatttctaacgattatgtatatgtaacattgacttggactcctaatcctcgtaatgtaaccccgactggtactttggcaaattctgataagactaaacaaatctggtttgctagcaattctaatgaaggaggttcaggctatgatgaaatccatgtaaacactgaagttcctgctgcaacaggtcatgatatcatgcgctttaataaattcattttggatacctttaatggtcatgatgttacaatttctgaaatagcttctgtttatacagactttgcagatgctgaactgactaagactttcagatttgttgatccgaaggatgctaaaatgactggtgtatctggaacaatttatacactgagtgtaaacgctgatcgtactcagttgttagctagtactccaactattgcaaatacagtcattgcgactattactgatgctgtagataataatggagaagatcttatcgcattggctaacaatgatattgctaaagatttgttgaatgttgccggtcgtgatgcattggctgacaacctgactgctagactttctgttgaaacagtaaatgaatgtggcaagtcattgaatgcggtagcaaacaatgaattcgacgttaagttcttgcgtcctatcactgtagaagctgataagatggataactttaaggatggtgtagacgttggtgcagaaggctctaagattgatcttaagttggcattcactgactggagaaatgaagcattcaagattgctccgattaactattatacatattatggtgttaaatcagttactattgatacaaaggaggctgagactaccataaatggtaaatatgaaccgatccctgccaatttacaggttaaatacgatggtgttactacagaagaaattgccaagggcaactttggtacattgacttatatcaacaataaagttgaagtaggtgagtttgatatcaaacttcctgtagtagttgaatatgcgtggggtacagtaaaatttgatattgtatgtcatgtagctaagactgtaggataaactgagtgagtaactctatttataataaacttgaagaaaagagtgctttcgggcactctttttttctctttacattatagtacgtatgagaaaaactaatttgttgattcttgggcttgcttcaatactcattgtttcgtgtggtcagggtggtaagaaagaggaaagagacgatccatctactgtaaaacaaactatggctttgagtaagaaagatactataaaggtattggaacttactaatcagtttatgaccgcagtaaaggagcagcgatatgctgatgcagctattatgctgcacgaaacgaaagcggatgatccttttgctcagccggaacttttggataatactcagttaaagagtgtgttgcataggctgaaagctttcccgatatacgattatagcattactgactatatttttaaagaagctcttgataatgaagtccgttgtaaggtgattttgtttcccaaaaatgatgagaaagatacacgtcccaatactactacctggtattttaagccggttcgttttctaggggagtggaagctttgttttagaagcagtacacagggggatcgtacttttgacgcttccaattaaaaatgctattgtgaggaattaaagatagtttaggtaaatatcttctaaatatgcaggtgctgatttaaaattagtacctgtttttttatgcataataaagatgcactgtctatagaatacaaaaacttttttctcttttcatccacttcaaaagaaccttttctatctttgtgcagatttgcgtgtaacgaattgcttatttccatcttttatttatcgggaaatatccgtcattcatcggggaaagaacgtgtatttatagaaatactctttctgtattgccttcatttgatgaactttgtgaccgtaatcctcgattatcaatcattaaaagaaagaacaatgaaaacaaaacaaaaaattcagttcaacagaggacatgcgtctgtaaagtacttgatagcatttctctttatcgcctgcggaggactccttttggcacgtaatatgcaatggatcacagttcccgtttatgacctgctggtatcctggcaggcagttgtggcagtagtcggcgtttattcattggtacgtcgtcatttagtgttcggactgatattactgggtatcagtgcctactacttgaatgatcagctcagcgctttgtgtggtacggatatgcaggcatttatgctgcctgctattctgattctgataggaattgtcactgtttttagtcatggtgggaaatctagagaccatgggtacggtcgaactccggaagaatttaaaacgatgaattatacctcggcagatggctttttgcattcggagaatgctttcagcggagtccgtcaggtcatattggatgaaatgttgaaggggggaagtattcagacccgctttggcggcagcatcattgacatgcgacgtacggacattcccgtaggagagacaccgttggatgtagattgtaaatttgggggcattgaactctatgtgcctgcggactggaccataaaatgtctttgcagcacattcatgggcggttatgaggataaacgttgggagagagaggaaaatcctcaaaaggtgctggtgataagggggactctttcgtggagtggcttggtcgttaaaaattaagacgggcggaatatggatacacatcctatacaggcgtcgccgcaaaggtggatagttgctttgggcttgctgctggttgccggcgtacaaggccttttcctgtgggggtacacagacgatggtatatgggtttccttgttggacggaatggctgcaactctgctgtttgccctatcggcttattgggcatggtatgttctcggctttgtccatatttccattactacgctttttatcactatattaggcatatcttgtactttggtgggcagtttctttatccggtggatcttggagtttattaatcatgcagtctacactccttttatactcacacttcctttccgcctctgttatgtggccttactgtggagcatcatcctgttatggtatcgtttgcaatctgctgcgggcgagcgtgaggagatggaaaatcaattggtaaccatgcaggaaacctggatggaagaccgcaggaaagcggaggccagccggaagaaagaggaagaagccggtgcggatgcggaagactgcctggatcggatcacagtgaaagatgggactaaaattcatttgatagaattggcggacttgctttatattcagtcttgtggcgactatgtgacattgattactcctgaaagggagtatattaaagaacagacgatgaaatattttgaaactcatctgcctggatcagactttgtccgtatccatcgttcggccatcgttcaggttaagcagatatcccgtctggaattgttcggcaaggagtcttatcaactgatcttaaaaaacggtcgaaagctgaaagtcagtaatagtggctaccgtttgctgaaagagcgcttaaatctctaatttatattgttaggtaatatggccggaaggaaaaggggagggtgacatgtgtggaactgtcctgtaacaggaatgaaatccgtttgtcatgaaacctttaatagagtgtaactctcacgaaacttaacccatctacttttgcgacagatttataacgcataaaaaagtatatgaaaaaggttgttagagctgtgtctcttatgctactgatggcaggtgtttgtggaaatgcatttgccgaggaaaatgaaaacattgtccggcaaggcactattcgcggacgtgtgatagacaatggaaaacaaattctaccgggtgcttccatctttattgagaatctgaaaaccggagtgatcagtgatgtgaacggtttctacacattacccaatctgaagcccggcacttacaccgtcaaagtgacctatgtaggttatagccctattgaaatgaaagttaccgttcccgaaggcaagactttagagaaagatatagtgatgaatgaaggggtggaactgcaggaagtgcaggtgaagggagcttttcaagggcagaagaaagcaatcaatacacaaaaaaataatctgggtatcaccaatatcgtatctgccgaccaagtagggaaatttcccgactcaaacataggtgatgcattgaaacgtatcagtggcatcaatgtgcaatacgatcaaggcgaggcccgttttggacaagtccgcggcactagtgccgatttaagctccgtcaccattaatggtaatcgtgtcccatctgctgagggggatactcgtaacgtgcagttggacttgattcctgccgatatgattcagaccatcgaagtaagcaaagtcgttacacccgatatggacggcgatgctatcggtggttccatcaatctggtaactaaaaattctccttataaacgtactatcaatgccacagcgggaagtggttacaattggatcagcgagaaagcccagttgaatttaggcttcacttacggagaccgtttcttcaatgacagactgggcatgttgctctccgcttcttatcagaatgctccttccggttcttatgatactgaattcatgtgggaacaaaatgaggatggcaaagtatatgtcagcgattatcagatgcgtcagtactttgtcacccgtgaacgtcaaagttattcggcggcttttgacttcgaactcaatgaaaaccataaattgactttcaagggtatttttaacaaccgcaatgactgggaaaaccgttaccgtaccaatatcaaggatttggacgagaacggaaaaggcacagtccgcatccaaaccaaagctggtactcccgataatcgcaatgcccgtctggagcgtcagcgtaccatggatttcgctttgggcggagaacacttatggggagcaatcggcatggattggaatgccagttatgcaaaagctacagaagaacgccctaatgaacgttatcttgacttccaactgaaaaagcaggaatttgatatggacttgagtgatgaacgccagccgttggcaacacccacagcaggttctaccctgacactgagtgataagttcagcttgaaagaactgacagaacaacaggaagacatcaaagaagaggatatgaaattttcggccaatttcaaaaccagtttgaataatggagccaaactgaagttcggtgcgaaagtagtacgtaaaacgaaagaaaaagaaatagacttctacgaatatactccgagagacgaggatgccttcatgaccaacagcctgaaaaatacggtagaccagagtacggataaatttatgccgagcgacaaatatcaggtaggaacatttgccagtaaagaatatgtgggtggattgaacttaaatgatgcttcccaattcgataaagaacaggtacaagccgaattggctgagaactttgaggctcgtgaaactgtaagttccgggtatgtacgatttgaccataaatttacctctaatataaacttgatggcagggctccgcatggagcacacttctcttcgttataccggtcgtaactatgatgatgaaacagataagaccaccaagaccggccgcgtcgtcaacagttatgtgaatttccttccttctattttggtgaaatgggatgtaaatgatgatttcaagatacgcggttcttacacgcagaccttgagccgacccaaatattcagctttggttcccagcgtgaatatcaaccgtggcgataatgaaataaagattggtaactctgacctgaaacctactatttcttacaacttcgatttgagtgccgattattatttcaagagtgtaggtttggtgagcgcaggctttttctataagaaaatagacgatttcatcgtagatcaggtactgaccaactatgaataccaaggaacagaatatacccgtttcactcagcccaagaatgcaggaaatgctaatctgtggggattggaattttcttatcagcgtgatttcggcttcattgctccggccttgaagtatgtgggtttctatggaacctatacttatactcactcacgcgtggaggactttaacttcgaaggacgtgagaacgagagcgggttgagtttgccggggtctcccgagcatacggcgaatgcctctctttactttgaaaaaggaggcttgaatgtgcgcctgagctataactatgcctccagttttatcgatgaaatgggcccaagtacattttatgacagatattatgatgccgtgaactatatggatgtgaacgccagttatacctttggcaagaaggtgaagatgaccttttatgctgaggcgaacaatctgctgaaccagccgctccgttactaccagggtacgaaggaccgtactatgcaggcagaatattatggcgtgagaatgaatgcaggtttaaaaataaatttctaaaaattaagtatatgaaaacgttgatgatgattagaaaaatgaaagaagtattgacatgggtatggattgttgtcattggtgcggctatctgcctgaatgtgtgtgcccagactccacaagattggaaaggactggagaaacaactgaatttttatatggctaacgatttgggacgtaacggttattatgaccagaagcccatagccgagctgatgggagaaatggcggatgttattggtcccgagtgtgtgtttgcagccggagacgtgcaccactttgaaggtgtacgcagcgttaacgatccgctttggatgaccaactacgagttgatttacagccatcccgaactgatgatagactggttcccgatcttgggaaatcatgaataccggggtaatacgcaggctgtgttggattataccaatgtgagtcgtcgctggtcgatgcctggtcgttattataccaaagtttttgagaagaaaggaactgccatccgttttgtgatgatagataccgctcctctgattgacaaataccgtaacgagagcgaaacttatccggatgcctgcaaacaggacatggacaagcaactggcatggatagactctgtgcttactgctgccaaagaagattgggttgtcgtaatagggcatcatcccatttatgctgaaacgtcgaaagacgacagtgaacgcagcgatatgcagaaacgtctggatcctatcctccgtaaacataaggtggatatctatgcatgcggacacattcataacttccagcatcttcgtgtgccgggcagtgatatcgactatgtggtaaattcggcaggttcgttgagccgtaaggtaaaaccagtggaaggcactcagttctgcagtcccgaaccgggcttttctatcttcacggcagacaagaaagaactggatatgcatatgattgataagaaaggaaaagtaatctatactgtaaaacgcaccaaatagggatagttattttagggaaaaagagtacatttgcggtgtaaaactgtaaatgtactctttgttatgttgaatacactccttttgattggtggtctggctcttattttggctggtgcaaatggcttgacagatggttctgcagcggttgccaaacgtttccgtatttctgatttggtaatcgggcttaccattgtagcttttggcacttcggctcccgaattggttatcagtgtgctttctgcattgaatggcagtgctgaaatggctattggtaatgtggtgggtagtaatatattcaatgctttgatgattataggctgtactgcgttggtactccccataaaagtaggtgaggggacgatgagtaaagagattccgttagtcattctttcttcattggtactgtttgtctgtgccaatgacatgatgctggacagggaagcggtcaatgttatcagccgttccgatgggtttgttctgttggctttcttccttatatttatgcgttatacatttgctatcgctcgtaatggggcagatgaggcaggagaagagcagaagattaaggaaatgcctgtatggaaatcggtgttgtatattgcaggaggactggccgggctcatatttggcggacagctttttgtcgacggggcaagcgggcttgcccgttcatggggtgtcagtgaatcggtaatcggactgacattggtagccggaggtacttccttgccggagcttgctacatctgttacggcagctttaaagaagaatccgggaattgctatcggcaatgtcatcggtagcaatctgttcaatatattctttgtactggggtgcagcgctacggtatcaccgcttccgatggggaatataaataatctcgatttaagtgtgctgattgcttcctccctgttgttgtggctggtaggctggtttttccgtaaacgtaccataacccgtcttgaaggcgcattgatggttggctgttatgtcgtttataccgcctatcttattgcccaacagtaaaaaagccataaaaagaataagttatctgcaaaaaaacttctatctttacaccctgaatttttataaaaatacagcatggctattaccattaaaaaagtcagttcaaagaaagaacttaagacatttatacggttcaactacgagttatacaaagagaatccttattccgtacccgacttgtacgatgatatgctgaatacgttcagcccgaagaagaatgccgctttcgagttttgtgaggcggagtattttctggcatataaggataacaaggtggtaggacgtattgcagggattataaataaacgcgcaaacgaaacttggaataaaaaagaagtccgtttcggatggattgatttcctggatgatatcgaaatatcacgcgccttgttggatgcagtagcccaatggggtaaatcgaagggaatggataccattcagggacctttgggctttaccgactttgatgcggagggtatgctgatagaaggattcgaccaattgagcaccatggcgactatctataattatccttattatccacagcatatggagaagttgggattcgaaaaggatgccgattgggtggaatataaaatttatattccggatgcaattcctgataagcataagcgtatcagtgatttgattcaacgtaagtttaacttgaaggtgaagaaatatacatcgggtaagaaaattgcggccgaatatggccaggctatcttcgaattgatgaatgaggcttatgctccgctttatggtttctcggctttgtctcaaggacagattaaccagtatataaagatgtatttgcctattgtagatttgcgtatggtgaccttggtgaccgatgctgaagataaactggtggcggtgggtatttcaatgccttctttgtccgaagcgttacgaaaagcgaaggggcgtttgctgcctatgggctggtatcatttgctgaaagtgctgtttttgcataaatatccccctatgctggacttgttgctggttgctgtaaaacctgagtatcagaacaaaggagtcaatgctttgttattctcggacttgattcctgtatatcagcaactgggattcaagtatgccgaaagtaatccggaactggaactgaatggaaaggtgcaggcccagtgggaatatttcaagaccgagcagcataaacgccgtcgtgcttataaaaagagtattctgtaacaacgatatataaaaatgtgataagtcaatatggaagaaaacaacgaactgataaacaatcccgctgtagaatataccgacgataacatccgccacctcagtgacatggagcatgtgcgtacccgtcccggtatgtatattggaaagttgggtgacggatcacatgccgaggacggtatctacgtccttctgaaagaagttctcgacaacagtatcgatgaattcaaaatgcaggcgggtaaaaagattgagattatcattgaagaaaatctccgtgtcagcgtgcgtgactatggtcggggtattccgcagggaaaacttattgaggctgtaagtgtgctgaatacgggaggtaaatatgacagtaaggcgtttaagaagagtgtcggactgaatggggtcggtgtgaaagctgtcaacgcattgagttcgcgcttcgaggtgcgcagctatcgtgatggaaaggtgcgtatcgctacctttgccaagggagacttgttgacggataccacacaaaatacaacagaggagaacggtacttatattttctttgaaccggataacctgttatttgagaattacagtttccgtccggagtttgtggaaaccatgctccgcaattatacctatctgaatacaggactggccattatctataacggtcagcgtatcttgtcccgtaacgggttggtggatttgcttaacgacaacatgacggctgtgggattatatcccatcatccatttgaagggagaagatattgagatagcctttacgcataccggccagtatggtgaagagtattactcttttgtcaacggacagcatacgactcagggaggtacgcatcaaagtgctttcaaagagcatattgcccgtaccatcaaggaatatttcaacaagaacatggattattccgatatccgtaacggactggtggctgccattgccgtcaatgtggaggaaccgttgttcgaaagtcagactaaaatcaagctgggctctaccaatatggctcccggtggtcctaccgtcaataaatttgtaggtgattttgtaaagactgaggtcgataactatctgcacaagcatacggacgtggccgatgtgatgttgcagaagattcaggagtcggagaaagagcgtaaagcgatagccggagtgacgaaactggcacgtgagcgagccaagaaggcaaatcttcataaccggaagttacgtgactgccgctttcatctgaacgatgtcaaaggggacaagaaggaggaaagctgcatcttcattaccgagggagactcggcaagcggttctatcaccaagagccgtgatgtaaatactcaggcagtattcagtttgcgtggtaagccgttgaattcttacgggctgaccaagaagattgtatatgagaatgaagagtttaacctgcttcaggctgctctgaacatagaggacggtatggaaggattacgatataataaggtaattgtagctacagatgctgatgtagacggtatgcacatccgtttattgcttattactttcttcctgcaattcttccctgacttgataaagaaaggtcatgtatatatccttcaaacccctttattccgtgtccgcaaccgcaagaaaggagtttatgaaaccgtatattgttattcggaagaagaacggattgccgctatcgaacggttaagccccaatcccgaaattacccgattcaaaggtttgggagagatctcacccgatgaattcaagcactttatcggcaaagacatgcgtctggagcaagtttccctccgcaagactgacctggtgaaagaattgctggagttttatatgggtaagaacaccatggaacgtcagaattttattatagataaccttgttatagaagaagacattgcgtgaatcactaacaaatatgagaagagccatatttccggggacatttgatccctttaccatcggccattattcggtcgtgaaaagagcattgacctttatggatgaagtggtaatcggtatcggtatcaatgagaataagaagacttggtttcctacagagaaacgagtggagatgattgagaaactttttgctgatgatccccgggtaaagatcgacgcttacgattgtttgaccatagactttgccagagctaaagaagcgcagttcattgttcgtggaatccgcaccgtacacgattttgaatatgaggaaaccatagccgatatcaaccggaaactggccggtatagaaactattctgttatttacggagccggaacttacttctatcagctctactattgtgagagaattattgcagtttggtaaagacgtaacaccattcttacctgaaggaatgaaaatagactgatcatgaaatatactatgtactttgcaggcttgattgcctgctttttttctattgtagccgtacaggctcaggaaaataagtttctgaattctccggcacgcaaattacagttggcggagtttgccattgccaacctttatgtagacgaagtcaatgaggggaaacttgtagaggaagccatcgtaaaaatgctggaacagcttgatcctcattctacttattccgacccggaggaagtgaagaaaatgaacgagccgctgcagggaaactttgaaggtatcggcatacagttcaatatggcagaagatacattgttggtgatacagcccgtatcgggcggtccttccgaaaaagcaggtattctggccggcgatcgtatcgtcatggtggaagatacgctgatagccggtgtaaagatgagcaccgaagatatcatgcgtcgtcttcgtggtcctaaagattcaaaagtgaatttgaaaatacttcgccgaggggtgaaggaactgctcccttttacggtgaaaagggataaaatacctgtttacagcctggatgcttcctatatgattaaagataagattggttatatccgtatcaaccgttttgccgccactacccatgaagagttcaagaaagcgttagctgaattgcagaaaaaagggatgaaagatttgattcttgatttgcaaggcaatggcggaggttatttgaacgctgccatcgatattgccaacgagtttctgggcaaaaaggaactgatagtctatacggaaggccgtcgtaatccccgtagtgaattttttgctaaaggtacgggcgagttccagaatggtcgtctgattgtattggtcgatgaattctcggcttctgccagtgagattgtgaccggagctgttcaggattgggacagaggagtcgttgtgggccggcgcagctttggtaaaggcttggtgcagcgtcccattgatttgccggacgggtcgatgattcgtttgacggtggcccgttattatactcctgccggacgttgtatccagaaaccttacgaaagcattgaaaagtataatgaggacctgatagaccgttataataaaggagagatgatgagtgaagacagcattcacttcccggattcactgaagttcaaaactcataagctggctcgtacggtatatggcggtgggggaattatgcccgattattttgtgccgattgatacgactctctatactaaatatcatcgtcagttgcgtgataaaggggcgttgatgaaagctcactttcattttattgatgcccatcgtaaagaatggctgggcaaatacaagactttcaatgaattctacaaacgttttgaagtgactccggatatgttggcacaactggttgctaccggcaaggagatgggagtggaatataatgaagaagaataccagaaggcccttcctttgctgaaattgcagatgaaagcattgatagcccgtgatttatgggatatgaatgagtattatcatgtcatcaatgatgccaatgaaagtatcaggaaagcactggagctgctggaacaaccggattttgaaggattgctgctaaaaaaacgatagtcaagactttatattaactgcaggagcgcatagttgcactcctgcatccaaccatcactttatctgtctcccgaacagcaccttattcagccatcggtttacataaatatttgcaaaagcacatcctactccgatcgctgctcctgtcactacatcactgggataatgcactccttggttcattcgtgcaaaccccactccacaggcccatacggcagaaggagcgatgacataccatttgggataagtgatagaaagcgaagttgccagggaaaaagcggcggctgtgtgtcctgaaggaaacgacgggctgtctgcatccggtgctccgtatgcatgaatcttatccggatactttacaaaaggccggtcacgtcctatgatatgtttggcagcgtatgtgatacctaccgcctcaatcacactggttcctatgtaaacggcatctttcagcatcggctggtctttctttatcaatgcatagagtcccatggcggcaggcactcctacgggcagaatcactccgctggcggatagtcctctgctgaggccgtgtaccttccatttattgatggttttcaatgtgttgatatctatattctgggccgggaggctgaatgtaaaacttactgtcaacaagaggaaaataattcttcgtatatccattttgtttggtttttgttcggtacaaagatagaaaaataatgtaattcgcatttacccttcccgaattaaagaataatttccataattccttgtattatcgctagaattcctttacttttgcatcgtgaatacacagcttttaacagaatttttagttctaacaattaaataatttaaattcaatcatttatgtggttaagtaattcatctattggaaggaaagtggtgatgagtgtcacaggtatcgcccttgtcctgtttctgacgtttcacatggcgatgaaccttgttgcgctcttctcggaagatgcttacaacatgatttgtgaattcttgggagctaactggtacgcgttggttgcaactgccggactggctgctctgttcgtaatccacatcatctacgctttctggttgaccatgcagaaccgtgcagctcgtggtagcgaacgctatgcagtgaacgttaaacctaaaactgtggaatgggcatctcagaacatgcttgtcctgggtattatcgtcattgccggattggctcttcactttgccaatttctggtacaaaatgcagtttgccgaaatcatcggtgttcatgatttaggtgcgttcggccctacagacggtgccgcttacatccgtgaaacattcggatgccctgtatttacagtgctttacctcatttggttagcagctttatggttccacctgactcacggattctggagtgctttgcagacattgggctggagcaacaaaatctggttcgagcgttggaagactattggtaacatctactctactttggtagttcttggttttgcagcagtagtcgttatctacttcgtaaaatcactcgcttgtggtgcttgctaatcgtaaattgtaaatgataaaattgtaaatgaatatggctactatagattctaaaattcctgaaggcgctttagccgagaaatggaccaattataaagctcatcaaaaattggtaaaccctgccaacaaacgtcgtcttgacattattgtggtaggtaccggtttggcaggtgcttcggctgctgcttcactgggtgctctgggtttcaaggtattaaacttctgtatccaggactctccccgtcgtgcacactccatcgctgcacagggaggtatcaatgctgctaagaattatcaaaatgatggtgactccgtttaccgtcttttctacgatacaattaaaggtggtgactatcgtgcacgcgaagctaacgtttaccgtctggccgaagtgtcaaatgctattatcgaccagtgcgtagctcaaggtgttcctttcgctcgcgaatacggtggtttgcttgacaaccgttcattcggtggtgctcaggtatcacgtacattctatgcccgcggccaaaccggacagcagttgttgctgggtgcttattctgcattgagccgtgaagttcagcgtggtaacgtgaaattgtacactcgttatgaaatgttggacgttgtgctgattaaggataacgaaggtgtggaacgcgcccgtggtatcatcgctcgtaacttggttacaggtaagatcgaacgttttgctgctcatgcagtagtaatcggtaccggtggttatggtaatacttatttcttgtctaccaacgctatggcgtcaaatggatcggctgctatgcaggtttaccgcaaaggtgcttattttgctaatccttgttttgcacagattcacccgacctgtattcctgtacacggtgacaagcagtctaaactgactttgatgtctgagtcattgcgtaatgacggacgtatctgggttccgaaaaagctggaagatgccaaggcattgcaagcaggaactaaaaaaccgactgatatacctgatgcagaccgtgacttctatctggaacgtcgttatccggcattcggtaacttggttcctcgtgacgttgcttcacgtgctgcgaaagaacgttgcgacgcaggtttcggtgtgaacaacacaggtttggctgtattcctcgactttaagtacgctatcgatcgtctgggtgaagatgtagttcgtgcccgttacggtaacttgttcgatatgtacgaagaaatcactgacgagaacccatacaagactccgatgatgatcttcccggctatccactatacaatgggtggtatctgggttgactatgaactgatgacttctatcaagggtctgtatgctatcggtgaagctaacttctctgaccacggtgcaaaccgtttgggtgcatctgcattgatgcagggattggctgacggttacttcgtattgccttacactatccagaactatttgtcagaccagattcaggttccccgtttctcaacagaccttcccgaattcgtagctgccgaaaaggctgtaaacgataagatccagagactgatgaatatcaagggtcatcgttctgtagactctattcacaaggagctgggtcacatcatgtgggactttgtaggtatgggacgtaccaaggaatctttgactactgctctggctaaactgaaagaagtaagaaagaccttctggagcgaccttcgcattccgggtgaagctaatgaattgaatgtagaacttgaaaaggcaatccgcctggctgatttcatcgaaatcggtgagctgatggcttacgatgcattgaaccgtgaggaatcttgtggtggtcacttccgtgaagaacaccagactccggaaggtgaagcacttcgtcacgatgacaagttctcgtatgtagcttgctggaaatacaccggtgaaggaaaagaacccgaattgatcaaggaagatttgaactatcagttcgttaaggttcaaactcgtaactataagtcttaattattaattgtatagaaatcatggataaaaatataagtttcacactgaaagtttggcgtcagaaaggtcctaaagacaaaggacattttgataccttccaaatgaaagatattccgggtgatacctcattcctggaaatgatggacatcttgaacgagcagcttatcaatgaaggtaaagaacctatcgtattcgaccacgactgtcgcgaaggtatttgcggtatgtgctctatgtatatcaacggacatcctcacggacctgctacaggtgctactacctgccagatttatatgcgtcgtttcaaagacggtgacaccattactgttgagccttggcgttctgccggtttcccggtaatccgcgacttgatggtagaccgtagcgcatacgacaaaattatgcaggccggtggttacgtgtcaatcaataccggtggtattcctgacgctaacgcaattcctattgcaaaacctattgctgacgaggctatggatgctgctgcatgtatcggttgtggtgcttgtgttgctgcatgtaagaatggttctgccatgttgtttgtttctgcaaaggtcagccagttggcactgttacctcagggtaaagtggaagctgcacgccgtgcgaaagctatgttgagcaagatggatgaactgggctttggtaactgtacaaacactcgtgcttgtgaggcagaatgtccgaagttggtttctatcagcaacatcgctcgtttgaaccgtgaatttattgctgcgaagctgaaagactaatcacggttagttttacttgatatttgagaatgccctgcctttggtggggcattttttttgcctggggcttcttctttttctctcttacgtatgtttctgggagaatcgccaaagaacttcttacagaagttggagaaatgtgagagagattcgaatccatgttcgaagcagatttcggagatggaagcctctgtatagcgcaattggtagaggatactttctttgcgctgcttcatcatccattcataggccggttcgttgaagatagccttgaaaatacggcggaaggtggtgacgctatagccgcccagttgtgcgaagtcttctacagactttatttgcttgtggtgttttaatataaaatattcaaagctgttggtatacttggacaaactgtgtacaatgggggaaagctcatagtctgtatagtagtgcgccagtagataatacagttctttacgcttgaattcaagcagttctttacagattttgtctatattcagataggaggtaactccttcaaggaaaagctttatttcgggctttattttaagtggctcggagatgagtggcgggggcacgtttttcaatatataggtatagcggtcataacagaaagctttggggtcatcgaatgtgtacagaataccttccgagtctgtcatggccagtatttccacttttgatgcgatagcttgcagtacaaattctccgggattgatgatagtaccggcatattcttcactattgatgagtatttggcctttgagtaagaaaaataagatattagtttcacacttatgtgggggtaagtggaaaccttttttgttatgtgtgtaatggatgctattctccactgctttagggcattgggtacaatccatcctttcattacagggcagaccagacatatatagatgttagagacgcttgtgttcttttttttgatttgacaaatgtaggtcaaatatggataatttgcaataagtttcaagaaaaagaccgaagaatcctgtttccacttgtttgtcttctgccgttacggaaaacgatagcctgtgggcatgagcatagagggctaaatttgtgtggccaaacaaaaagaagttgcaattgttgggaaagtagcagaaagaaagtatctttgtgtgtaccccatggggaggtataccggctaaaacagcatagattatggaatttgtagtatcatcagataagaaattattgccctacggcatgatgaatttcgcggatatacgccttgatggttattattatgtggacaagaccatgtatatcccgttgatagaacgctccaaccgttattttttctttatccgtccgcgtcgtttcggcaaaagtctgacgctgaatatgctgtaacattactatgatgtacgaaccaaggataaattcgacgccctgtttggagacctctacatagggaagtatcttacacgtgaccggaacagctacttggtattgtatctcaatttctccggtatcattggcgaactgcataactatcgtgccggattggacgcacattgccaaacctgtttcgactatttctgtgatatttatgcggaatacctgccgcagggtatcaaagaacagttggacgcaaagaatggggcggtagaacaattagactatctttatcatgagtgtgagcgtgtcggtcaggatatttatctttttatcgatgagtatgaccattttaccaatgccatcctttcggatgccgaaagcctgcaccgatatacgaaggaaacgcacaaggaaggatatctgcgtgcattcttcaacaagataaaatccggtacctattccagcatcaaacgctgtttcattaccggagtcagtcctgtgacgatggatgtggttgtttctaggggtattttatgattgaggacggctgattgtcaacaggtaaaaatgctccgcaaatgaaatcgcaaatgatagaggggatgatgcggtgtttcattgcggagcggggaattgttatgtttatctgtatgtttgtcgggggatttgtaaattcattaatttatagtttgttggtttcttataatacaggagttttaggagtttgctcgttatcagtggcattccaatcttcatcatatgttgtgtttacactcattttttctgcaccaaccggtaaagttagtatatagcggatactttgcccattagtccattctcctgttaaagctacttcttttgatccgttaaagaatgttgcattatctttctctgttttatacttgactgtaattttagcatcagtaagagattgtgggtacagcattaatgaattattattttgtgtataatcataaatatcatctttggctgttacggtgttatcaaatgtatagctataaccactagcaggtgcacttcctgtgatattccaatttccaccttttccttcagttcctccgaatgtgtacgttgcggcaccaccttttgcaccggtgatagttatgctttcaactgtgtaagtatagttgctgtcagctagttttgcagcaaagtttatacgggttaagatgtgttggaatgtaaggtttaatgtattatcacttggcttagttatatctttggaataagctactataatatctttctgatcggccggggtatcaggaagggtatagctgatggtgggataagcgctggaactagcaggtgctgtataggttacatcattggtatatccaaaaaattgcatttctgttataggccaataaaaagtaccacttgttgtagcccaattaccttgacctcctttatattctatgccatccatatacgcgttaccccatcctgaagtggcgatatcgctgcttttaattatataggcatgtaatttaaaagacgtgaaactactattacttgtaacagtggcccttgaactctttttgacaatcgtgtttactcctatctcatttttacttttgggagttccattgtcaataccatcaatctcattctgtgagcaacttgtgattgccaatgcagctaaagctgcaaataaaatcttcttcatatcctatgtgttttaagttaataattctatgactctttattctatattttaaccgaccggtaattctacattcgtttcatcatcccagtcactgacgttcccatcaaatccaccgccactttcatcaggaggaatctctacatcatccaccacaatcttctcatcatccggaagttcgatctctatctccggctcttgaggtttttcatcgccttctcccggctcgtctttatcttcaggaggttttaccgcttccgttatttctactttcgcttcctgtttggaaccatccacttttactataatcaagttcagaaactgagtgatatcggctcttgcttgcgtcagtttgggatgcccaaagcaggtaaaactcccttttatagccccattccctttactggtttcacaataaataggagcgaaccggcataggctggctcctttgcccaggtggtaacattcagccattccggaaacactgcccaggatggatgcaacatttttcagcccttctgtctttattgaaaaagtgtaagtggttaccacagattttggttttacctctagtgtcggtaattcttcctcttttcctatctctacatcgtccagggttgctacataaaaattatccggtccccataccatgtctttcgtttcctcggcacccagtcccgtacagtttcctgtacatgccattattgtttcgtagctaccttcgtcttttatttgcactacttcggtgtcataattgtaaatcactgccgaataatgtcccggaggtacttttatttctccgcctttcgccggtaagtaggtatcaatcttccttccttggccgtccttgggatagaagatgatccggactccttccggcagacggtcggttactccttcccaatttagacggatgtttattcctgttacggggtaatcgtccagaatctcgcggcggctgcatcccactaaagtcaatagtgaagataaaagtacaagaattgcgtaccttgtctttttcattttcttcctcttttcttggttatcaaccataccaacgaaatttttgctttcgtagggcctataaaggtgtaatttccgctactcatccagactagtgatccctcatagggagtatatttttgatattccgtggtcagatagcctatgcctaggctgaattccaatgccagatgtcgtgacaacaaagtggaatatccataagtgaatcctgccgcaccgtaatatttaccttggtagccgtttcctttaaactgaaagtcgtagatacctccctcgatatacaatccaaagaaatgtccgttcaatcggttgtgtagttcacggttgcccagccagtaacggctttctattcctcccgaaatcagttggtagcagatttctttactgctgttggaccaccaggggcttttatattccatattcactgaccatctctttcctacaggaatttctatttctatattaggtgccagtgccagatcgtacaataaattatttttcagcgcaagcactgtgttgtcgactgtctggactcttcttgctgccttttctttgggcttttctccccgtttctcttttgtctcttttttcttttctgcctttattactgttttttctgtttctattattacttgtgttctttccttctgtggaagtacttgcatcgtcattggcgtaacggtcgtttccctgtcaatcggtatgaattcagtttcttctatccttgctgcctgttctgcggaggagttttttcctccgttttcttccggataagacaggcagactcttatctctgtccgtctgagttccggtagcactcggtcagaaatatactgataaggtatgccggcgtccaggcgttgcaagaaatcttgcatttttacgggattgtcatggtgataatctatcaatgccaatacatcttcccggtcggggaccagtctgtcgtccagtatcagtttccgtaaggcatccccgtactcttctcctttgcggatacagatttgggcggtattgacctgcggatatttcccacataagaacacttttacttcctcacttcttttttgtcccagcggtatgccctgttcttttttaccattatataaatccggtgaaaccagaataatggaattaagatggatgctgtgggcaggattggcaagtagagaatccaataccgtcagcgttttaccgtttccttggtaatccttgtctatctgtcgggcattcaggtcaaaatagagcgtcatgtccaacgtggtgtctttggggttttcgtactctattgtccgggcataaatgctatttggcagtaggcacaaaagcacaaatatgctgaatatagtagtgcgtttttccatgaattaccattatgtatgaagcaaatataggtgataaaatctgaaaaaagacttattaaatgttctattttcggacttgaaagggtttgtgaagcgattggatagaatttgcaagttttggcggttggataatgagaagggcaggggacttacttttattttggatgaataacatgagggaatactttctttttgttttttactttccagcagacaggaatgaatcattctatgatattgatagaataatgtttcatattccttttttaaccccgcttttcttgtcggattgtaatactgtgtgcgaaaacgattgtatttgtgaaataatactaaatgaaaagcaaaaatgaaccaaatatttggaggtattgagtgtaagttgtacatttgtcatgtgatttttttcatagtattagatttaaggttaacaaaggttggagcaaggcgttgctcctttctttttttagtaccttctgtttctttccattctcctaatcatcagctccttaatgccgttgattttttaaaatattctgtttcttgttttcatccaatggattttatgttatctttgtgtcaatgtaaactaactaacaatctacatgaaaagacacacaaaccttttatgcttgggggctgctgtcgcattgctgaatgcttgcgccccggtggtgaacgctcctgagcctgttcttcctgttcccgagaaaaagcaggtggactggcagaaaatggaaacttatgctttcgtgcatttcggactgaatacttttaatgaccgcgaatggggttatggagattctgaccctgccacgtttaatccggttaaactggactgcgagcaatgggtgaaaacttttgtggcggcagggatgaaaggagttatccttacggcaaaacaccatgacggattttgtctgtggcctacggggctgaccgaatattgtatccgtaacacaccttataaggatggaaaaggagatatcgtacgtgacctttcggaggcttgtaaaaagtatggtataaaattcgctgtctatctctcaccgtgggacaggcatcaggccaattatggaactccggaatatgtggattatttctatcaacagttacacgaattgctgacccattacggtccggtgttcgaaatttggtttgatggagctaatggaggggatggctggtatggcggagccaaagactcccgtaccatagaccggaaaaattattatgattatgcgcgtgcatacgagatgatcgacaaatatcagccgcaggccgttgtcttctcggatggcggacccggatgccgttgggtaggtaacgagaatggctttgccggagctacaaactggtctttcctgcgtgccggagaggtttatccgggatatcctaaatacagggaactgcaatacggtcatgcagacggcaatcagtggacggctgccgagtgtgatgtgtctatccgtccgggctggttttatcatccggaggaagatgacagggtgaagacggtggagcaattgacagacctttattaccgcagtgtggggcacaatgcgactttgttgctcaatttccctgtaaaccgggatgggctgattcatccggtagattcggcgaatgcggttgacttttataagaatgttcagaaacagctggcaaacaatctgttgaaaggtgttcttccgatagtttccaatgaacggggtggaaagtacactgcaaaggcggtgacggatggagaatatgatacatattgggctacggaggatagtgtcacatcggctgtcatcgagtttgaatggccggctccgcaaaaggtgaaccgtatgctgttgcaggaatatattccgttggggcagcgtgtacaatcctttgtggtggaatataataaagaaggggagtggctgcctgtgaagctgaatgaagagacaaccacaatcggttataaacgtttgcttcgttttgaaacagtcactacggacaaacttcgtataaactttatggaatcacgcgcttgcttgtgtatcaataatatagaggcttattatgcaggagaaaccccggatgtgtttactgcgaaagcggaagaactgaaaacgtatccgtttacattgccgcaggtagatgaggcggaagccggaaaatgtgcggataaagatgccgccacgacttgctttgtggatggcaatacgcttttgatagatttaggtacggaacagactgtttcttccttccattatctacccgatcagagcgagtataacaaaggactgatagctgcttatgagatttcagtgggtatggaggccaatgctgtgaatcaagtggtgagcagcggggaattctcgaatatcaagaataatccgattctccaatcggtttatttcactccggtaacggctagatatgtattgctgaaagcagtgaggatggtggaaaacgagagtccgatgggctttgccgaattaggagtgcaatgaccatgtatcaatatactcatgtgtccgttcacaatacagctaccgtatgtcaatgagtacatgagtatattgatacatggttacattattaatcggtacactcctcctgccagtgctcgtatcacccctttcatttctaattcaaacagtaatgcactcattcggtttacaggtatgttggtgtctatcaccaatgtgttgatttgtaatccttccggtattttgccgagtcgttttactattcgttcttcttcctcgcttaaatcagggaacaattcccgttgtactgttttctcagttttggggctgctttcccatcccatacccttcactaaatcctcggccgatgtgataagcactgcctggtttttccttatcagattgttgcagcctatggaatattcatcattgcatcgtcccggaaaggcaaaacagtcccggtgataactttccgccagttcggcggtgatgagggctccccctttggcggcggactcgataacgacggtggcgtcactcatacctgctacaatgcggtttcgtttcacgaaattttgcctgtcggggttggttccgcttgtaaattcggtcagcaaacctccctgttccaacatgctgacggctgtcttccgatgttcggcaggataaatgcggtccagtccgtgtgccagcacgcctatggtcttgaaatgattctgcagggcggcgcgatgcgcatggatatcaatgccataagccagcccgctcactatcaaggtgtttgggcacaataccgacaagtcggcaaggaaacgggtgcagatatcctgcccataaggggtggcatgacgggttcctactatattaataatatgcagcgtgttcagatcggcatttccccgataaaataaagctagcggagcatcatcacattcacgcaaacggctgggataaccttcatcatttaaggtgaggcagcggatatgatttttctgacagaaagttaattcctgctctgcacgccggaaagcttcggagttattcaacgcagtaatgatcttttcgcttactccggggaccaattgtgacagctctttgcggtgttcgaaaacacgggtggcgcttcccagactgctcaccagtctgaatgcgcctgtcagtcccaatcccggtatccgggttagggccaggctgcaaatttgttcgtcttgtgtcattcgctcaggtagggtgcgaaagtctcgtcaaatagagcgctgtcccctaatctgccgtttaccacgcatactgattctacagtggccttgacagtcactttcatatcgggcagacggaagatgtcctgatagaacacatatttaataccttcttttttcagatagagtttagaaacgaattcgtcaccgctgcgcagcggagttttgaacgccatggtgagccgtgccactaccgggtccactccttcctcgtgcagacgggcgaagctgatacctacggatgtgagaaactcatggcgtgtatgttccagataatgttgatagttggcattgttcacaataccctgcaggtcgcattcataatcgcgtaccttcatcttcagttcataaatatacttttccataaagcaaaggtataagaaaaatgtgttactttgcatctaaactaaaaaaaagaagtgaatgaaactatatgctgcgcctttgcaaggttttacggaagctccctggagaaactttcatgaggaagtttttggtggaatagatgcgtattatactccttttgtacgaatagagagaggaggattccgtaacagggatgtacgggacattgctcccgaaaacaatacggtttcccatgtagtgcctcagctcatcgcgtccactcctgtcgagctggaacggttggccgctttgtttacagagaaaggatataaggaagcggattttaatatggggtgtccttttccgctggttgcaagaaagcacaagggctccggcatattgccttatcctgccgaggtagaagctttattgaaagagttgacacattatcctgaactgagtttttcggttaagatgagattgggatgggagagtgcggatgaatggcggctgttgttgcctttgctgaacgctgcccccttgcggcggatcgttctgcatccccgtatcgggaagcaacaatacaaaggagaggtggacttggctgcgttcaccgctttctatgaggagtgcgcgcatccgttggtatataacggcgatttactgacggtggaggatatccggaaagtggaagagaaatttccctgcctggagggcgtcatgctgggacgcgggttgctggccaatcctgcattggcttgggaatatgtaaacggaacctctttttctcccgataaattgcatgaaaaggtgaaggcgcttcacgcacgccttcttcaatattatgaagcccatttacagggagaggcgcaattgctgagtaaaatgaagccttattgggaatacctgctgcccgatgcggaccggaagataaagaaagcaataaagaaggctacaacgatggataagtatttgacggcggtgaaccagctgtaatgatggaaaaggggcttcaatacatgaaaaccggagtgcttcttcagttcattcatccggtataactgcttgtaaaatagggaagtatcctgataggagaaccttcagtttcctgtcagttacttccagcccatatttttgttcttacctgttagatgagaggtgtgttcgtcatgcctgtattttaagaaatacttatctgtcttttcttggagcatatcttttatcttccttgttatgtatccagttacttcctgataagtttatcgtttcactaaagtgatgaaaccttatcactctagtgatgaacttgtaccactttagtgatgaaacttcatcacccaagtgagacgattgattcttcaagacgaaaacacaaacttgtcctgatgaaatcccttttacataaggatgtttacgcttagtcacttttcatcccgaaaggccggaaagcccttgacaaaggcttttcaatgtgctatctttgtggaaacaacaactaaaaaaacaataaaatcatgatgaaagaaatgattcggaaggtgatggaatggtgcaagttatggaacggtgaaactgcaacggcgaaacaggcaggcccttcttcggataaaagggaaaaagaacaggctgcggataaccgggaagtacaagaccgtctggagaactacttgtggaaacactatgagttccgtttcaacgtgttgacggaacagcccgaatattgcgcgaaggggcaagggacggacacaccttataagatagtgactcagcgtaccttgaacaccttgtgcctggaagcgcaccgtcatcgcatcaattgctgggataaagatgtgagccgcctgctccattcggaacgcttggaagattatcaccctttccttacttatatggatacactgccccaatgggacggagtggaccgtatcactccgctggcgcagcgcatctcgaagaaaactttctggataaacggcttccaccgctggatgctgggaatggccgcccagtggtcaggacgcatggaccgttgcgccaatgcagtggcccctatgttggtgagccgtatgcagggcaagtgtaaatctactttttgtcagttattgatgcccgatgggttgcgggattattacacggacagttttgagttgacgggccagtcgggctgcgaacagaaactggcgcagttcgggctgattaatctggatgagtatgaccgtctttctcctcaaaaactgccgttgctcaagacactgatgcagatgaagaagttggatttccgtaagtctcaccgttcatcctacagtcacctgccccgtatggcctcgtttataggaaccagtaatcataaggatttgctgaccgaccccacgggcagccgccgttatctttgtgccgaggtgaaggagaaaatagactgcactccgctggagcacaagcaattgtttgcccaattgaaggcggagctggacggcggcgagcgttattggttttcggccgaagaggaagcggaactgcaattgcgcaaccgcgagttctatgccatgcccgtagagcaggaggtgttctaccgttgttttcatctgcccgaggcaggagaggagttcaaactctattcggcttcggtcattttcaccattttgcaaagccgttatcctgccgctatgcgcggcatgacggtggtgcgtttcggcaagatgatgagcgccatgggggcggaacggatgcatacggagaaaggaaatctgtataaggtggtgctggcggcataattcccgtccatcaggccggctgagagggctgacaggaggctgaaggggcttctgtcagtcttatttgttgtgtgacagtgtgttaaccacgctgaatggtctgaaggcggggtacatgaatgccaaaaaacatactataagaatctttttaaaaagccgttttctcaagaatttgtactaagtttgcaaccaaactacataattaaaaaaactatgattaacagattcgtattaaacgaagtatcttacttcggcccgggtgcgcgtgaagtgcttccacaagagattaaacgtttgggcttgcataaggcatttgttgctacagacaaggatttgattaaattcggtgtggctgataaagtgttgaaagtattggagaatgcaggtattccatacgaaatattcagtgaaatcaaaccgaatcctaccgtaagtaatgtaaaggcaggagttgaagcttttgcaaaatcaggagcggactttattctggctatcggcggcggttcgtctatcgatacttcgaaagcgattggtatcatcactaataatcctgacttcagtgatgtggtgtcactggaaggtgtggctcctacaaagaaaaagtcagtgcctatcattgcactgcccactaccgccggtactgccgccgaggtgactatcaactatgtcatcacggatgaggaaaaccataagaagatggtttgtgtagatccgaacgatatccccgccattgctattgtggatgcggaactgatgtacactttacctaaagggctgactgcttctaccggtttggacgcactgacccacgccatcgaagggttgataaccaaaggtgcttgggaaatgagcgatatgtttgagatcaaggcgattgaaatgattgcccgttatctggaaactgctgtcttcgagcctaccaatgcggaagctcgtaacggcatggccgtggcacagtacattgcaggtatggcattctctaatgtaggcttgggcgtggttcacggtatggctcatccgttgggagctatcttcgatattcctcacggtgtggctaatgcactgttgctgcctgtcattatggagttcaatgctccggctgctttgcccaaatatgtagatatcgccaaggcgatgaatgtgtacaaggatggcatgagccaggaagaggctgcgaaggctgctgttgaggcggtgaaggcattgtctgtcaaggtgggtatccctcagcatttgtctgaactgggtattaaggaagaagacttgccccgtctggccgcttcggctattgccgatgtgtgtacgccgggcaatcctcgtgaagtgacggaagaaattattctggaactttacaagaaagcgttttaagcgtaattcttttgtaataaaagcatagatggtgtgtggatgtgcagggcatatccacacactttttttatctccttgcctttgaaacagcattgtcactttgtagcaatttgttcgtaatccattcagcattcttttgcacttgcaaattaaatttaatgaaaataggtattattgttaaactgctatcaatcatttgaacatgaaaattcttattgagtcaaagagatttttgttgttattatgcttgtcgctattcgttgcgggctatgtttccgcacaggattaccgggcgattgtaaaaggtattgtgactgacgaaaccggagagggggttatcggagccacagtgttggtaaagaacgaatcgaccggtttcagtgccggttctatcaccaacgagacgggagagtacattgtgaagcaactccctttgggttcaccttactctgtcaccgtcagctatgtaggctatggtgatcagaaaaagacaggatatacgctgaaccaaggtgatgtgctccgtctggatttccagttaaaggaggaaagtgtcgtgatggaggctgtacaggtggtggctaattcattgaagaattctatcgccactacgggggccgctacttcggtgacggccaatgatctgaacaaactgccggtgaacgggcgtaactttacttcgctcattgacctgtcaccattgagtacaggttccagcctgtccggacagttggcttcttctactaattataccattgatggcatgagtgccaagggccctacttcgggaggtagtacaaccagtcgcaacggtgtgccatacgccatttcgatggaggctatccgtgagttcaaagtcgtgacgaatgaatatgatgtgactaacggtcgtgccggaggaggtactattagtacggtgaccaaatcgggaaccaaccaattgacaggtagcgctttcacttatctgcgttccgactggttgtccagcaaatatgatatccggggcaacaagcgctcgaatgatttctctacttaccagtttggagcctcattgggcggtgcattggtgaaagaccgtgcccacttctttatttcttgggatcatcaggctgattcacgtccgttgtatattgccgatattcataatgctgccgatgaaaagcgttataatttgactacggagaccagagaccgctttctggaaatagcccgcaataaatatggagtgtcggaccatcctcagttcgggtcttttgataaaaaacagaataccgatgcggtatttgctcgtctggactggcagattaatgctacaaacctgttatcgtttactgataattttgtgaatgacaataacaatatgggcttgagcgacaatagtgctatcaatctttatgaagtgtatggtgatgtacattcgttgaacaacagcgctttactgactttacgttctgtactgggaccacgcagtaccaacgaactgaagttgcaacatctttatacattggaaaaatccatgccgggcagtgaactgccggctgataatattccacgtgccattgtgcaacgtgtagaatcggaaatagatggaaacacggcgactactaccattcagctgggtggtcagcgttatagccccgagaatttctataatcacgtacttcagttggtagataattattattataataccaataaggtaaactatacatatggttttgatttgatgtacacgaatctgaattctcgttacggtagtgaggccaacgggcgtttttattttaccggactggataatttcgaggcattgaagccttctcgttatgtacgtgaagtgtatttggatcctgaccaaaacaatcagcgtgtacgccaaaatatattgaatgcaggtatctatgcccagttgcagactaaactgttcacaggattcgagctgatggcaggcttacgtttggataatgccacttatttcaataaaggtaatttcagccaactggtgtatgatgaattgggactgcgtacagacaatggactctctactttccagattcagcctcgtgtccagattacttgggactttaatgacaagcacacggatattcttcgtattggcgggggaatctttgcatctgatatcaacaactatgccatgattaataatatggtatttgatggtacgaaagtgatgtcggttgatatcaagaatacggaagaagaaccggatatagttcccactcccgattttatagggtatcggaaagatccttccacggctccgggtattgatttgctgaataatcccaaatatgcggacaaggctgtacctacgatcaatatgaatagcaaggatgccaaggttcccgtggtttataaggcgaatatatcatacactcacttcttcagtgaccgtttgaaaatgagtgtcagcggatatatgactttgggacgtaacaactatatgtatatagaccggaacatggtggatgatccttattttcgtctttctgcagaagggaaccggggtatttatgtacctgcttctactataggaaaagatggtactcttgattggatggaaggacgtaaaagtaccaaagtagggcgtgtgctcgaattggtcagcgagggaaaagtaaatcagttcgctttcaccgtagatggaacatggcgttactataaagacggagaactttctttcagctatacttggaacgatacaaaagacaatacttcctataatggtaatgtggctaattccgctactctttcccaaatggtggttgacgatccccgtgatttaagcaaaatgacttactccaacaatcagttccgtcataaactggtggtttatggttcggcgcctactttctggggcattaccgtaggtgctcgcttttccggcatcgggggaacacgttattccatgattgtgaatggaaatgtgaacggtgactttgtggatagtaatgacctggcctatgtatatgatccgaatagcagcgctactcctgattatattcgtgaaggtattaattctatattgaacaatccggatgcggaaaagagtgtgaaagattatattcgtaagagttttggtaaagtggccgaacgtaatggaggggtcaatggtttctatggcactttagatcttcgtctggccaagaaattcaagacttacaaaaagcagaatctggaagtgtctgttgatattttcaatgtggccaatatgttgaataaagattggggagccggtcataatctgggaacacagaaaatttatagtatcaagggatttgacaaagatgccaaacaatatacttataatgtaaatgccaacacaggtgtatccagtctgaacggtactccttttcaggttcagataggtttgagatatggattctaatagataatgattaaataagaaataaagatgaaactaagtaaactaatgatggcttttgccatgtgtgctgttactttgaccgggactgcccagaccaaagtgattgcccaccgcggatattggaaatgtgaaggttctgcccaaaactctattgcttctttgacaaaggctgcagaggcaaaggtgtatggttcggagttcgacgtacaactgacgaaggacaaggaaatcgtagtcaatcatgacgatagcattcagggaatttgcatttttgatactccttttgctgaattgaaagatttgaaattgagtaacggcgagaagttgtccactttggatgattatctggtagcgggtaagaaactgactggtactcagctgatattggaaatcaagcctcacagaaccgaagaagcggaaaatgaagcggtaagaatcattgtagataaagtgaaaaagatgcgaatggagaaacaggtggaatatatttcattcagcatgaacatttgcgaacagttggtgaaactgagtccggattcggaaatagcttatctgaaaagtgatgtggctcctaaagacctgaaggcgaaaggaattaatggtattgattattatatcaaggtattggctgagaaaccggaatggattgctgaagcacatcagttgggtatgaaggtgaatgtgtggacagtcaatgatatggagatggttcagaagatgattgaccagcaggtggattatataactactgattatccattggaaactgaaaagctgattcggaaaaatggaggagattcttaataaaaatgtaattcctttcaaatagggatgtaataggaacacaatacatttgcactgtaatttaaaaaaggataatatgaaagctggtttattaaagaaaatctcattggctttgggattggtattatgggtgacaggttctgtatgtgcatcgcctgctgacgaagaaggtgctaacaaggctaataacaatctggtaaaggttcttgttataggacttcacgacaatgtggaatccaactattttcccggcagtatgattactgaggaaactggaataccgactgatagcatagattatacttataatcagattatagcaaagaatattattgcatccaataagaataagaaataccagttcgttactccggaaaaggcggcggccatcagcagtttgttggataaaatcagactggaaggtgaagaagaggagaggtatgcggatcttagtcaggtggatgataatcggtatgaacagctgataaaggatactgattcggattatgtattatttttgaatcagcattatttgaaatggcaggaaaagcctttgcgtactttgtttcatatcaccagttattctttgtttgataagaatcagaaggaagtaacccgaggtaataactattttaccagcatgaatttggaaagtaaagataagttgagtaaggatagtcggaaaagttcttcaaagatagtttccactattgtaaaaagcttgtcaaagtgatgtcgttattcagaaaattataagaacaggtggggctgaagttcaagacttcagtcccctttttctattttcttttcagatattcgtaccctatccggcaatacaggcattttttcttatcgcaatattctttctttaattgtatcaaagcttggctgtcggcggcattggaagctttcattccgtattgttcccacatgcgggtgatataattgttctccgctttcaattcttccagaaaactgccggcacgtgcacaaagtacaggatttcctttatgcagtccgtaagcatagagaaatgtcactaccgtgttgataatgagtaaatccagtgaggtgttacttagagccttcggacgggaaggggaagaaccgccaaatgtataatgagtgagccagtattctgaagttcctcctttcagaatatctctgacaccttgtagtgtctccgtttccatgatgcgagagagtagtccgtaggcacgatgataaagacatgctaactgtgcaatccgtatatgcggaaaattagtaggacgtagccggagaaaacgccatagggaagtattcatcgggataagttcgaatttgtgctgtagatagatgtattctttttttagccggagatagtatccgtctccatcagaatcttccagaatgccggcttgtccaaagaagatggcttctatctggaaaaggtcgttccgatgtttgtctaccgcccggaagggaagctgatgagcccaggtttcgaaagcgtctccgttcagcccgaaaccgaaattacgtgccagtgtgataaaaaaagcgtcttcccaattgccttgacaacgttttaaccgttcattcaataaggtcgctttttgctcgaatctttccatctgtaaggcggacatccatgagtgggcggtgaaaggggagagcgaaggaatgatgcggtaacaaggagggtagctgtctgtttccaacagttccttgtagttggtgcggaccgcttccgggcagatgagttgtatttgggggattctttctccattgctcctgctgatttccatatctatttcggaggctatatgcagaatgacagagttgtaaccggcatctgcatgatgtccgtgtttgaaccagtctgaagatctttcatgtatctcgatattacctatccaaagtacaccgtccagcttgagcttggcattaaaaaaaccgggaccggcgtcggtattcgccagtcccgtatctataacttccacttgttggccggttgttgttttcagttctttgagagaaaatattttatgtttccatacatagtgtaatagttgttccatgttaatgaggtgtaaatgtttggcaaatgtaatggtttacaacgaaaaacgctatctttgtggctgaaataacattcgtaattatgaaaatagcattaataggatatggaaagatgggcaaggagattgaaaaggttgcagttgcccgcggacatgaaattgtgagtattatagatgttgataatcaagatgattttaattcggaagcatttaaatcagcagatgtggctattgagtttactaacccgatggtggcatatgacaactatatgaaaacttttgctgccggtgtcaaattggtatcgggcagtaccggatggatggacaaacatggtgatgaggtgaaagaattatgcacgaaaggtggaaagaccttgttctggtcgtctaacttcagtctgggggtcgctattttctctgctgtaaataaatacttggcaaaaataatgaataactttcccgcttacgaggtttctatgaccgaaactcatcatattcataaactggatgcgcccagcggaacagccatcacgctggccgaagggattctggaaaatatgaaccgcaagagtaaatgggtgaaagggaccatggtggcaccggatggaaccgtgtcgggaacatcggaatgtgccgagaatgagtttcctgtaaattccatccgtgaaggggaggtgtttggtattcatactatccgctatgactctgaggcggatagcatctcaattacccatgatgccaagaatcggaaggggtttgccttgggagctgttttggcggcggaatatacatccaggcatgaaggattattaggaatgagtgatttatttcagttttaagatatgataaaagcaacacgtacacagtggattaagtttgccgttgttctggcgctttacctgatatttcttgtttggttgagaagctggctgggattggtggttgtaccgtttatcttcgatgcgtatatcacaaagaagattccatggacttggtggagaaagtccaagaaccgtcatgtagtgaccgtcatgggatgggtggatgctattgtattcgcactggtggcagtatactttgtcaacctctatttcttccagaactatgtgattccttcttcctcgctggaaaaatcattgctgacgggtgattatctgtttgtgagcaaaatgagttatgggccccgtgtgccccagactccgctgcacatgccgttggcgcaacacacattgccgttttttaattgtaaatcataccttgagcatccacaatgggattataaacgggtgaaaggtttgggggacgtacagttgaatgatatcgttgtctttaactttccggccggagatacagttgccactggtgtgcctaatgatgatgtttatcgtctgagttatggagcaggcaaggagctggcaaaaccggtggatttggcttccatgactccggagcagcaacgggtggtctatgattattattatcagttgggacgggagtatctgaaagagaatccacagaatttcggtgagataataagccgtccggtagaccgccgtgagaactatgtgaagcgatgtgtgggtttgcccggacaaacgttggagataaaggatcgtattatttatttggatggtaaagctaataaagagcctgataatgtgcagtatcgttatctggtgaaaaccaagcgtcctattcccgatgacctggctcatgaactgggtatcagcaaggaggatatgatgatgtattatacggatgcttctgtttataatatgcctctgacagaaaaagcgaaagcaggtttgttggcgcgtaaggatattgttgtcagcattgagaatacaccggctgatgatgcgggaggcttatacccgctgaatatgtataagaactggactacggataactacggacctgtatggattcccaaaaagggagagacggtgaaactcacgctagagaatcttcctgtttatgagcgccctattcatgcttacgagggtaatgaactggcagtgaaagatggaaagatttatattaacggcaaggaaaccgatgagtatactttcaagatggattattactggatgatgggagataaccgtcataattcggctgactcccgtttttggggatttgttcccgaagatcatgtggtgggaaaacccatctttatctggttgtcattggataatgaccgtggctggctagatggaaaaatacgttggaaccgattgtttacctttgtagataatattaaataagttgcgcataccctgtattcctgtatggataaaagcaatgcttactgctgtcattctggtactgttggtaaagacatttgctttcacctcctgcaccattccctctaccggtatggagaatagcctttatcaaggggaaagggttctggtgaataagtggagttatgggtttcgtgtgcctttttctatctggcgatggttgggaaaaactgccgggaagggggatattgtgttgttcaacaaccctaatccacggtttcctcaaacgtcggtgggcaaccgggaggtgtttataagccgtgtggtaggaatacccggagatacgttgatgttgaatgatgaactgtgggtgactgacgaacaagtgttgagcccggatagtaaatctttgtatgtctattctcatacggaagaagaaacgatgcaggctgccatgcagcaagtgaacattcagggaaacaggttagtgggatatgccgaggggaagtacatacgtaccttcagtcattatgaatattacctgttaaaacaaaaactggcaggaaaagtggatttgattcctctctatcataaagatataagcaagagccatccctttgtgatcccggaaaaagggaaacctgtcaaggtatatccttggaatgtgaccttgttgtgtaatactattgttcgccatgaaggaagagtggcttctgtcaggggagataccctgtatgtagggggaaaacctgtagaagcctatacatttaataaaaattattactggatggcatccaataatccggtgaatttgtgtgattcacgtttatttggtttggtgcccgatgaccatttgatcggtaaagcttggcgcatttggttttcatccagaaaagggcgcatttttcaacgagtgcaataatggagaatacgatatatttaagttcggcctatctggccccggtggaatattatacaaaactgttcgcctgtgagaaggcctatgtggaacagtatgacaattatgtgaaacagacttatcgcaaccgttgtgtcattgcggcagccgatggtccgctggcgctgactatccctacagaaaaaagcggtacacctaaatgcctgatgaaggatgtccgcatttcggatcatggcaattggcgtcatatacattggaatgctttggtggctgcatatagaaatagtcctttctttgagtactatgctgatgatttccacgtcttttatgaaaagaaatatgccttcttgtgggattataatcaggaaatttgttctttagtatgcgatttgatcgatattcatccccgtatggaaggaacaacggaatattgcatggaatttgttccgggcgaggttgattttcgtgagattattcatccgaagcgtgactggcgtgaagcggatgctgacttttgccctaaaccttactatcaagtttttgatgccaaatacggttttctgccgaatttgagtatcgccgatcttttgtttaatatggggccggagagcctgattgttttgcgagatagtgttaaaggtataaaccataaagaataatatcatgaataatttgtttagtgtaaaagaccaggtggtggtaatcaccggtggaacaggggttttgggaaaggctattgccgcccatttggcagaagaaggtgccaaggttgttatattaggccgtaaggcagaagtaggaaatgccattgtaaacgaaatcaaggccaaaggcggggaagccatgtttcttgtaaccaatgtgttggatgaggctatattggagcagaatctgaaggatattctcgcagcatatggtcgtgtagatgcattgctgaatgcagcaggaggtaatatgccgggtgctacgattgctcctacaggaaatttctttgatttgaaggtcgatgagtttcaaaaagtgcttaatctgaatcttaccggaacagttctgcctacacaggtatttttgaagccgatggtggagcagaagaaaggggctattgtgaatttctcttctatggcggcattccgtccgatgactcgtgtatgtggttatgcggctgcaaaagcgggaatctctaatttcactgcgttcatggccaatgaagtggctacgaaatttggtgaaggcatccgcgtgaatgccattgctccgggattcttcctgaccgaacagaaccgtactttgttgacaaacgaagatggtacatatactcagcgtggtaatgatgtgattcgccagactccgttcaaacgtttcggtaaagcagaggaactgtgtggaaccatccagtatctcatcagcgatgccagcagttttgtaaccggtacagtagccgtagtagatggtggtttcaatgcatttgccatgtaacaagtctttagtttttaattctcaatttttttatttgatatgattttatgtgagcaaacatggcgctggtacggaccgaatgatcccgtatcattgtgggatatcaaacaagccggagcaaccggtattgtcaatgccttacatcatattcccaacggtgaagtatggacagtagaggaaataatgaagcgcaagaaattgattgaagaagcaggattaacttggagtgtcgtagagtccgtgcccgtacacgaacatgttaagacacagacaggagactatctgagatatatcgagaactataaacagagtttgcgcaatctggcagcatgtggtatctatattgtgacttataacttcatgcctgtactggattggacccgtacggacctggcatatacgttgcccgatggttccaaggcattgcgttttgagcgggctgcttttgtagcgttcgatctgttcatcttgaaacgtccgggagccgaaaaggaatactcggccgaagagatagaaaaggcaaaagcgcgtctggcacaaatggatgaggaagaaattcatcgtctgacacgaaatatgattgcaggattgcccggttcggaggaaagttttacattggagcaattccaaaaagaactggaccgttacaaggatattgatgcggacaagctccgcaataatttgattttcttcttgaaagaaatttgtccggtagccgatgaaatgggagtaaagctggttattcatccggatgatccgcctatgtctattctgggcttgccgcgcattatgagtacggaagcggatttcaagctgttggtggaagctgtacctaatccgtcaaacggactttgtctgtgctgtggttcatttggcgtatctgcacagaatgatttgccgggtatcatggaacgttggggagaccgtatcaattttgttcatttgcgcagtacccaacgtgatgctgaagggaacttttatgaggcaaatcatctagagggtgatgtggacatgtatcatgtagttaagaacttgttgaaagtgcagcaacgtcgtggaatatctattcctatgcgtccggatcatggccatcagatgatagatgatttgaacaagaaaacaaatccgggttattcttgtttgggacgtatgcgtggccttgccgagcttcgtggcttagaaaaaggaatagcgatgagtatggaaacaaaataatcttttttttaacatatagaaagaaggcctgaatgtcttccggtgatgaggtatatccggaagtattcaggtcttctttttgtctaagaggtagataatgaggactattctagacaaatatagagattaattagacaaataaagaggtgcaggcaaggggaggaggtttatatttgcaacagatttaatctaattaacccttaaattcttttattatgaataaaaaaacaaaactgctttcaatccttggattggtgacagctatcctgtttttgttctcatcggaggtgttggcccaatccttatctatcagtggtaaggtaattgacaaaaacagtcaggagcctgtaattggggccagtgttttaattgaaggaacctcaaacggtacaataaccgatttggatggtaactttatgctttctaatgttccttccaaaggaagtttagttgtgtcttacattggttatgctacacaaactcttcctattaatgggaggactagtttcagtgttgtattggctgaggataccgaaacgttggatgaagttgttgtaataggttatggcgtacagaaaaaagtgaatcttaccggatctgtgtcttcagtgaaaggagatgcattggaacgtcgtccggtagctgatgccacacagagtttgcaagggatggttccggggttgttggtgagcaactcaaatacgggccgtccgggagctagtggtacattgactttgcgcggacaaggcaatctggataataatgcgaatccttatattttggttgatggagtggaaatgagtctctcggacgtgaatccgaatgatattgaaagtatttctgtattgaaagatgctgctgcttgtgccatttatggtgcacgtgcggcgtatggtgtcattttggtcactaccaagaaaggtgaggaaggtaaaatgcgtgtaaattaccaaggaaacgtaggttggagtacgccgactgtattgcctgatatggttgattcctatgaatttgctcagtattggaatgccggatgtattaatgcaggttctcctcgtttgtatagtgaggaaaaaatggggttattacagcaatatattaaagatcccagtagtgtggatccttggttcgagcttcctaaaaattctaatatgaacccggcattcgaaaattcagaattaggagtaggaaatactaattatttcgatttgcattataaggattgggcattcaagcaaaatcataatcttagcttgagtgggggtggcaaaaaagcacaatattatatttctggtggttattattcggaagatggtattctccgttatgccgatatggatttcagccgttataattttgccgctaatatttcttctcagattaccgattggatgaaggtaaaagtaaatacgaagtttatgcattccgatgaggatactccttttggtgacggagggcttagtgaaggcttttatcattcattagcacgtttccgtcctacagttgctcctattgatccgaatgggcattttacagaactgactatgattccttatttgcagagtggtacgtatacaaatactcaacgtgaccgttttagtttaacggcaggtttagatatccaacctgtgaaaaactggtttatcttttttgattatacatataaattgatggatttggaatatgaggcattgaacgtgagcccgttaatttatggggctgacggggtgagtacttcaaaaggtgtgcgtgatgagttgggtgtatcacccgatggcaagtttacccgttattatgcgcatactcgctaccaatctataaatttatattcgaattatctctttactttgggagacaagcataattttaccgtaatggcaggttatcaggaagaaaataatgactatagttatatgaagaactcgattaccggactttattcaacttcaaatcctaatgtaggtatgggaaccggtgataagacggtagtcgatactcgtaatggctgggcaacccgtggctttttcggacgtgtgaattatgattatgacggacgttatcttcttgaattgaatggacgatatgatggatcgtcacgttttgccaaaggtaatcgttggggcttctttccatctgcatctttaggatggaatattacccgggaacagtttatgatgccaatagccgatgtagtttccaacttgaaacttcgtgcttcttacggattactgggtaatcaggcgggtgcggccctttatacttttgccgctactatggatttgaatgataaattgggaaattatatattctctgatggacgccacatctttactaaggcccctgccgtagtcaacccgaatacgacttgggaaaaagtggagagtaagaatataggtttggatttcggtttctttggtaattcgttgaccggttcttttgatgtttttcaacgtgatacgaaggatatgttaggacctacggtggatttcccggatttctttggtgcagacgctcctaaaaccaataatgcccgtatgcgtaaccgtggttgggaattggtgctgagttatcgtggaaaaattggaaaggatattgactatagcataggcggttctctttcggatgctactgctgaagtaactgaatatgaagggactagaacaaatcctaaagataattggtataaaggaaagaaagctggtgaaatttggggatatcgggcggacggactgatccagactcaggcagaggcggatgagtataataatacctatgatttgtcttttataagcggtaaaccttggacgccgggagatgtaaaatatcgtgacctgaatggggataagaaaatcaataatgggcttaataccttggatgatatgggtgatatgacagtaatcggtaataccactcctcgttatcaatataccattaacggttcaattagctggaaaggtgtaaccgtaagcgctatgttccaaggggtcgctaagcgggactgggatcctggtacgggagcttatttttggggaagcggaccttatgcgcaggtgacggtgtttaaagagcatttggattattggagtgagacaaatacaggggcttattatccaaaaccttatattcatacagcaggaggagtggttcctttccgtaataagacaatgacgcttagtgaccgttatctccagagtggtgcttattgtcgtctgaaaaatctgacagtgagttatgatatccctgccgtatggacaaaaaaggtaggtttacagaaagtgcaggtgtttttctctggtgagaatttgttgacttttaccactttgaaaggaatgtttgacccggaagctatctttaccaagaatgattacacggctgaaggtggaaagaactatcctatgaacaaggtgatatcttttggtctagttgttaacttataatttgatgaatattatgaagaaaagaaatatatttttgggtctggttttgatgttaggtcttaccggttgctatgatttggataagatgcctgaaggggtattgtctacgacgattccttttgcaagtacgggggaaatgagaaattatctggatcaattctatcagacaggtaattataaatatgactatgtcagctttggtgatggaatgcgtgcgcaaggttttgatgccggtggtggacaatatattgccggggcagatacacatagtgataatatggcttccagttcggttagtacccgtttggcaggtgaaacgacattgagtagtgcggtcaaactgcaaaattatacagctatccgtaatttaaattttatgctgtgtaatttagataattgtgtggaaaaaggatctgctgattataatcagtatgtgggtgaggcttattatttccgcgcatggtattattatcagatgtttatcagctatgggcgcctgacgtgggtgaacactccacttgatcctaatatggaagaaatgaaattgcctcgtgctaaccgcacgattattgccgacagtattttggctgatctggataaagcggtgatgtatctcaatactcagaacaatagtgctaccatgcggattcataaagatgtggcgcgtgctttgaaaagtgaagtggccttgtttgaaggaacttgggaaaaataccataaagcgaaaaatgataagttttttgattctacggtgaccgatgaaaaaattcgcgattattttaatcaggctgttgcagctgcaaaagaagtgatggatcgtggcgtatgggccatttataatactggtaacaaattggatgattatcgtcagatgtttcagactacagatttatcgggtaatccggaagtactttggtataaacagtatgatggagatcagattggtaataatgtaaaccgttacttaaatcaaggaggagggagtgtaggtgttacggcttcattagtggatgattatctgacaattgatggtaaaccgtttgttggtgatgagcggattgaagcgaaaaaggtgttcgggaatgaattgcagccgactttgcgtgatccgcgtttgtcacagactgtttgtatgccggggcagcaattacgtccggatgacaaggctccttattatgttgtaccgccattgattggtacttcatcctataatcagaatatgactggttattctttattaaaacatgtgcaaattgattatacgggcagtctggatgccgagttcaagggagccacaccggctattcagttccgttatgcagatatcctgctgaattatgcagaagctctggctgaactggatggtgtggggaatgcgcagaaaattattgatgccttgcaacctttacgtgaccgtgtaggtatgcctccggtggattttgacagggagtataatcaggaagctgattatggtttccgcaatcttgataagtatattcaggctgtacgtcgtgaacgccgggttgaaaaagcctgtgaaggacgccgtcaggaagatatcatgcgctgggctgctgcggacgaattaatagtgggcaaatggccgaaaggtgcgctctttgtgggaagtaatcttgagaaccatcctgtatatggtgataagttaatttatgatcaagcttcgggaaataatcttttcctgacaggcaagcccggggatccgttgcgctatattatacctacgaatcccgcaggatatgaatcgggttggaaatttaatgtcaaccgtgactatctgttacccattcagacacgtatgttaggagatttgaccggtggtatgtgggaacaaaatcctggatggtaggaattatgttaataaaaaaagatatgagtagagtaacacctgtgttattatattctttgacgggagcagtggtgttgtcatcgctgtcttcctgcaaagaaaagaaatctgaagaggtaaaaaaaacgatgaatgtagtctatatcatgtgtgacgaccattcttatcagacgatcagtgcctatgaccaacgttatatgcagacgcccaatattgaccggatagccagtgagggtgtccgtttcacaaacagctttgtagcaaactctctgagtggtcccagccgtgcctgcatgctgaccggtaaacatagtcatgccaatggatttacggataataccaccacatttgacggtagtcagcagacttttccgaaattgcttcaggctaatggctatcagactgctatgatcggtaaatggcatctggtatctgaacctacaggattcgattattgggacatcctgataggacaaggagattattataatccgaaatttattaaaaatggtgaacgggtacaacgggaaggttatgctaccaatattgtgacagatttagcaataaattggatggacagtatccgggacaagagtaaaccattctgtctttttattcatcataaggctcctcatcgtacctggatgcccgatctttgtgatcttgacttgtatgatgatgtgatttatccgatgcccgaaaacttctatgataaatatgaaggtagaattcctgcatccaagcaggaaatgagtattataaaggatatggatttggtgtatgacctgaaaatggcggataaggagaatgagatccataccacgacaggactggaagaagcgggcagaaatatgtataatgctctgaacccggaacagaaggctgcttgggataagcactatgatcctatcattgccagattcaaaaaggataaactgacgggtaaagccttggcggaatggaaatatcagcaatatatgcatgattatatgcgagttattcattctgtagaccgtaatgtggggcgtgtcttgaaatatctggaagaaaatggattgatggggaatacgatgattgtctatacttccgatcagggcttctatatgggggaacatggttggtttgacaaacgttttatgtatgaagaatctttccgtactcctctgatggtccgtttgccgggtggaaagaaaggtgatattgatgaaatggtacagaatattgattatggccctactatattggaccttgcaggagtgaaggtgccatcggatatgcacggagtttctttcctgcctttactgaaaggagagaaagtttccgattggcgtaagtcattgtattatcatttttatgaatacccggctgaacatgctgtccgccgtcattatggtgtacgtacagatcgttataaattgatgcatttttataatgacatagactgttgggaactatatgatttacaggaagatcgtatggaaatgcataatatctacggacaacccggaacggaaaaattaacaaaagaactgaaagacgaattgttgcgtcttcaagtgcagtatgatgatcctatccggaatatatacaaagactgacaacctaatctaacctaaatttaacatagtatggagtattcccgattcttctatttgcaagaaggtcgggaatcttttttcctataatcagacggactcattcccactatattcttaaatacagtactgaaattacgtgagtgtttgaatcctgtctgttctgccacttcgccaatggataatgtggtcgtgtctaataatttacgtgcatattccagacggcatttaatgatgtattcgctgatgcccatatccatcatccctttagtcttattgtagagtgatgcacggctcattcccatttgttgtgctatgaaattaacgtccatatttacattgctgatattttcattgataatgcggttgaattggatcattagctgttcattgatataattcaggttctcctgtttttgtatagggatatctatggtggcatagtgatttttcatgaagttgtgattatgcatgatattctgtatctgaataaacagcaaatccatatcgaacggtttggtaatataggcttctgcgcccattttgtatccttcttccatactggtgtcatcaacgcaggaggtaagtaagattacgggcatgtagtttaaatcaggcttttgtttaatatagcgacatagttcgaagccgttcatgcgaggcatttttatgtcacttaatacaatttggggacgtcgtgacgtgaggatagggagtgcttccataccatcatgggcttcatatacttcttcaaacagaacttgtagattacaaatcaggtaattacataagtcacgatcatcttccactattaaaatagaatggaatttctctatgctgtcttgttgaggttgtttgcgatctatgtcggctgatagatgtaatgcgtcattcaaataggtttgaggtgtggattgaatgtcggcggcttcctgtctatacggtaaggtgaaaaagaaggtcgctcctttggtttcattattttgtgctccgataatgcctccatgcatttcgaccagttgtttggcatatgacaagccgattcctgaaccttgcaggctatgtttgccttgatagaaacgggtgaataagttggcgatatcctctttttgaagtcctgttccttcgtcctttacagttatccggatgcggctcccgttgccttccagataagtggaaactgtaacggtagagttttcttcgctgaatttataggcatttgtcaagaggttatttataatgatttcgcattggctatggtcgaaatacatactatctatagcagtatcgggagcaaatatcaacgaaatgttacgtaatgaaagttcatccttgaaatcattcaggatactttgcagccattcattaaaaggcgcgggagacatgcgcaggatattcttctccacctccattttgcgcatgttcagaatcatgtcaatgatatttttcatttggcgtgcctgtttgaatgcaccatatagcttgctacggagttcgtatgggatttgcttgctatttgtgagttgtttcagcggtgtatagattaaggttaaaggagtgcgtagttcatggttgatattgattaacgcttttaccttttccttatagatggtacgttcttgttccttgtattttcgtttcagatgttggtcgtgggcttgtatggcatagataatggaaagaataatgatgactgcacatattaggatgaaccaagactgctgccaccacggaggaagaacggtaaatttcagtaacgtgaattcagaactccaattcccatcgttttgggtacattgaacagttatgctgtaattacccggagagatggtgtgcaaaataagatgaggacgggatgtttccgtgtattctttatttaacccttttatgcggaaccgatatatacgcttgtgaaaaacattttctccttctagttgtgtatgtatttgtagagaggagaaattgtaaggaatttccatcgttgattgggaattgaaggggactatagtaccgtttaaagatacttcctgtaattcaagagtgatgggcggaggaatggaggcagattttagggctttgtttattcgtaccaatccttcagaaccacccatgtatatattgccgtcactagccaccaatacaggtttggccaagaaatcattaggtaatactccatccatttcattgtagattacaaaatgatttttttgtggattataagcgtatatgatccctaatgatcccatccatacgattccttcatgatcgatgactaaagaagtgattacgtcgtttccatcgggtaactttaagggctctttacggtttgagggcaggtaaattcgggtaattccgttaggtcctgctatccatagagtccctaaagtgtcaatgcttgcagctaatatttggttgttcttctcataagctatggtttcgtattcattcttttctttattgtactggaatacgttgcttcggtcgtgaaaaaaaggataagtacggtattttcccatgtagacccaggaatattgcaattgttgattactgggaaaaatgggaatcaattgttgactaccgggtatatatcgataaaaagcattgccatatagttcgatttcgttttgatcattaactcgtatattggtgggtgcactggagcttgccagctttgtttctgcatctttgtccggaagagagaaacgttggtagcttccagtctttttattgaaacgaaaaattccttttgagaaactggacgctagcagttcggtttcggataaaggacaaatagatactatcttttctcccaatgtttgcggatagtgggtaaaatgttccgtttgcgggtcaaagcagttgatgccgcctccatctgtaccaatccagattcgtccgtctttgtcttcccataaacataaggggcatttgtcggataaacctgaggctgggttttgtgcagctttggtataggtggtgataaagcctttttctgctcctaatactccttcccggaccatacctatccacatgtggttgttgctatggcataggcatgttactgagttggctgggaattgtcggttttccttgtttgataagatttgaatatcacgagtgtccggatagatgatattcactccgcctccgtctgttgccagccaaatggctttattccactctgttatatcaagaacgatatcgttgctcaagtttgaattacgggtattataggaggtcagcagttgtccgtcctgattataacattttactccttgcccataaaaggaaacccagtaatgtccggaagaatccttatatagatcgtatgcattggatgattcaccgaatggagaagcggttatttctcctgtatgtttatttaataactttattttccatgcattgtttattatcaagtaatgagtggaatcgaaaggctccatcttgataatacggattcctgttgtttttaaagggattgctttggaatgttttaattctttttcatatacaagtaatgtgtcggttacaggtatcaacagtttgcttccttctgttgctataatggaagtctttaccggtttattatgccgcagaaagatttgcagggagtctttctcatattcataataactgattccttgtgaggtgaccgcccatatccgctcttcattttctccgaaaatatcgttgatgtaatggctgtttttacgtaataagtccggtagattatatttcttgattttttctccattgaaacgatatattccctgagtggttccgacccataatgaaccgtttttgtcatcgtatagggatgttatagaggttggaagcccttctttaatagaaagttgtttaaaatgataataaggacggttgatggaataagtctttatgataaaacaacatagagccaggattacatagacggtttttctcattcagataaggtcttaaaacaaatatttgtacaaatataagaaataggttttgaaattcaaagcggtaaagaggatattgataaccgaatagctgtgatattatatgtaatttgtcattctgaacagatgtagaagataacatagtgttcagaatgacaaaatagattggagaatgagggggatttgtctaacaggttttttgtccttataatgggatttttttcagtttttcattctcaaccattattttatatttctttcctttagttgtcttaaaggtaaaagtccggttaccatatctcagattgcagggttcaccggctttggacaaaataacggcctcttttaatttaccatcctgccaggtaatgtcaatttcaaagttacctttggcacaaagcccctttacagaaccttctttccatgcgtctggcaaggctgggagtaattggatgaatcccatgtgactttgcaacaacatttctgtgataccggcagttccgccaaagttaccgtcaatctggaaaggcggatgggtatcccataagttgtccaaagttccattttttagtaagttgccaaatagtttgtaggcgtggttgccgtcttgcagacgtgcccattgattcagtttccatcccatgctccagccggtagctccgtcaccgcggtgttctaaaacaactttggcggcatgggttaattcgggagtagtaattggtgaaagggtgtggcccggatgcagtccgaataaatggttgacgtgacgatgctcgtctttggggtcgtctatgtctgttgaccattccattaactgaccataacgtcctatttgataggatacaagatgtttcaatacatattgccattgtttacggtctttggaatcgacacccagtgctttgctggcatcaatggcattgagtaatatttcgcggactacagcatgtacaaaagtggctccttggtctacaggtccatgctcgggagaagtggaaggagcagcagtataggttccgtctggtttatgccataaatagtctatagcgaagttggcactgctcttgataagatcatagcctacttctttcaggaattttttgtcgcgggtgtaatcatagtattcccaaatgtgagttgccagccagggacctgccatcgggttaaagttccaggacatattttcatcggtcaaaggggaggtgaatccgaaaatgtttccggagatggaggctgtccatccacgtgcgccgaaataggcttgggctgtcttttctcccggtttcaccaaggtacggatgaagtctatcaaaggccatacacattcgttcagattggtggagcaagcaggccagtagttcatctggatgttgatattattatggtaatctacatgccatgggccatctaccccgttggcccacattccttgcaggttggccgggagattgccggggcgtgaactggcaattaataagtatcgcccgaactgataatagatttcttccagccggtagtccggatttcctttgcgatagcgtgctagacgttgataggtggggaggtctgtaacggcaggatattgtaaggtcatgggagcacgagggttcagttgtagttggactcttccaaacagttgggtatagtccgttttgtgccgttcgcataattcgttgtaacttttggcggcggcagcgtccatcatggctagggttgtttgttccggatcaggaccgacatacgtcttggggtctttgaagtctggattgaagttgagtttataatcggtatctgcggtcagcagaaaaatgacttcatccgcattgcggacaatgaatttgccatcagtcgtgttcaggcttcctcctttgtttatggcttgtatgcggagagcaaatttcatttggttgtttttgaggcaaccggtgtagagtaaacgattgggaccatctgctttgatatcacctatggcttcagggttgctgccatagctgaatatcaggttttgcataccgggacggtcggctgtgaacttcagcaccatcacgctgtcggggtaggaaacaaagtatttacgctcgtagttcacttcatctttgcgaaaactgactactgccatggccgagtcaagagacaggatgcgtttataattggtcataccgatctcacttaaaccggtttcgatgtaagcttctcctaatgtagtaaaggagccgaaacgaaaaggtgtttcacggcttggctcataatcggctagtccgttgaaatttttgcaggtaagttcttctgcttttttctggttgccgtctgtaaatgcttggcggatttcgggtaataggtgtgctgactctttatttacgttccaataataagctgctcccttttctgtgtttggtcctccgcgccatagtgtcttttcgtttaaagtgattcgttctgccgctatagatcccataacattgcctcccaaactgccgtttcctatggggagcgagttgttttcccacgctttgtctgttacaggagaataccaggaagcgcgtccgtccaaattattaggggtatcaaaccagatgctcaatcctttggtgtaatctgtactctgtgcctgtaaggaagctgcgaataggcttcctaaaatgcatagctgaagtttcttcataaattaatgatattagttaaaggtatttctacaaaaatacaattagatttttatttgtgagaaatgtaatgtttgaaatttagggtgatttcctgtttttataggtatatcagggttgaaagataattttcatcgaacatttcattggcgatatcccacaaatgttctgctgtcagcatttctatccgtttgaatacttcttccggaccttcaaatttaccatagtgtaagaaagtttttcccatatccaatgcattgttctcaaaattgtctccggcaacccctatttgtccgatgatttgtttttttgcagcattcagttgtgaggaacttagtttgctgtcacgcagttttttcaattctttatgaactagtccgatgcaacggtctgcatcttccggatcagttccgaaatagatgcagaacactcctgtgtctgtgtatgaggtcagattggcttctacgttatagaccagcccccggcgttcgcgcaaggaaacgtttagccggctgttcataccaggtccgcccaacagattgttaagcaggtaaagtccggttcgtttttcattatatgcattatatccccggctgcctatcattacatgggcttgatgtgtttctttattcagtgtcaatgccttaggaatatagagaaaaggttctgtccgttggcgttcagtaatggaaaaagggatgtcggctgtcactttctctatggtgcgtatcacttttttaaagtctatattgccttgaatgaaaaagatcatattggtagctttgtaaaaacgggaagtgaaattcaaggcatgtttgcttttgaaactacgcaataagtccggttttcccaaaatatttcttcccaaaggatgatcggggaatatcaattcctcaaaatcatcaaaaatcagttctgacggactgtcttcataactttgtatttcatcaataatcacttccacttctttgtcaatctcatgttgtgggaaggtgctgtgaaatacaatatctgccagcagttctgctgcccgtgagaagtgttctaccaggaaagcactgtatatcactgtttcttccttattcgtatatgcatttaaatctccgcctacattttccatgcggttcaggatgtgccatgcatgtcttttttgtgttcctttaaagataaggtgttccacgaaatgggccattccctgttcttgttcgttttcatcacgggttccggcatcgacggcaaagccgcaataggctacattagactgattgggagcgtgaataatgcgcagcccgttaggcaaggtgaaagtattgtatgacattgttttttgcttcaaataagtttcggttggcaaaaatacaacaaaagttattgccgttcttcaaaaaatgcagatatttgtatttactaacagaaaacaagatgatggataaaattgctattttctgttccgcatccgagaatatagagcctgtgttttttgaaaaagcacgtgagttgggcgtttggatgggacaaaacaagaagacgttagtgtatggaggtgctaatattggattgatggaatgtattgccaaggcagccaaagacaacggttcgatgataatgggagttattccgaccaaattggaagaacgtggacgagccagcgatttggtggatgtgactttccgtacggataatttgagtgatcgtaaagatgtgatgttgaatgagtcggatgtagtgatagctttgccgggaggagtgggtacactggatgaggtttttcatgtaatggcggccgctacgctggactatcatcgtaaaaaagtaattttttataatataaatggcttttggaatggcattatcgactttttggccggattggagaggcagcattttgcccatcatccgttgaacagttattttgctgttgccaatgacttgagagaactaaccgaactacttaaataatattcatgtaacctattatgatgacatctatacacgaattgttgcagaaagaggctcaggctgttttgaatattcctataactgatgcttatgagaaagcagtggaattgattgttgagcaaatacaccgtaaaaaaggaaagctggtgactaccggtatgggtaaggctggacagatagctatgaatatagctacgactttttgctctacaggtattccggcagtgtttttacatcccagtgaagcccaacatggggatttggggattttgcaggagaatgatttgctgcttctgatttctaattcaggaaaaacccgtgaaattgtggaactgacacaacttgcacataatttgaacccgaagttgaaatatattgttattaccggaaatgcggatagtccattggctagagaatctgatatttgcttgtgtacagggcatcctgatgaagtgtgtgctctgggtatgacccccacaacttcaactacggttatgactgtgataggtgatattttggtagtggaaaccatgaaaaagaccggttttaccatcgaagagtatagtaaacgtcatcatggaggatacttaggtgagcgttcacgtgagttaagtaagtaaaaaaaatagaaccaaccggaaggcaaggaacacaaatagaattttattaaaggacttgtgtcatttgtgttccggttttatgtatatattaaattgtaaatataaaaatgagaaaagtaataggtataggtgaaaccattctggatattctttttaaagatagccaacctacggcagcagttcccggtggctcggttttcaatggaattatttcattggggcgtttgggagtcaatgtaacttttatcagtgaaacgggaaatgacaaagtgggcgatatcattctgaagtttatgcgagagaatggagtaagcatagatcatgtgaatgtgtttcctgaaggaaagtcacctgtgtctttagcttttctgaatgaacagaatgatgctgaatatcttttttataaagattatccacggttgaggctggatgtgacaatgcctgaaatacatcgggatgacattgtgatgatcggctcttattatgctgtaacgcctcaattgcgtgataaagtaaaagaactgttggataaagctcgtgaaaaaggggctatcatttattatgacgtgaatttccgcagtactcacaagaacgaggcgataaagctgcttcctgttattcttgagaattttgaatatgctgatattattcgtggctccgttgaggattttgagaatatgtttggtttgacagatgcggataaggtttataaaagtaagattgaattttattgtccgcattttatttgcacgcacggtggaaaaggaattcgcctgtatacaaagaatataaaaaagcattatgaagcggatcctttgcagactgtcagtacagtgggagccggagataattttaacgccggagtagttttcggattgctaaaatatcgtatccgtcgggatgatttggatgaactgtcggaagatgactgggaccatgtgattcgttgtggaaaggatttcagtgccgatgtttgtatgagtttgaataattcgatttcaaaagagtttgctgccggttacaaataaatcgaatagctctcattgttttaaactcttttattatgtatgagaacctttaaattaatagcaggtcttttctttttgctactggtggttgcttgtcaggacaaaaagcggtcttcgcagattaaggtagcggagaatgagtcgaaatatgtggttctggcatatgtcacttcatggggagaaagtacgcccgatccggcatgtttgacccatattaattatgcatttgggcatgttacagataatttcaaaggaatacgtatagataatgaaccacgtttgcaaatggtggtggggctgcgtgaaaagaaaacgtctttgaaagttttgctgtctgtaggcggatggggaagcagtaggtttagtgagatggcacagacagatagtacacgtatggcgtttgctgcagattgtaaacgggtgatagaccagtttgatttggatggaattgatatagattgggaatatcccggtataggaactgccggtgtatctttttcgccggaggatactgataacttttctttgttgatgaaggatgtacgccatgctatcggtaaagacaaactgctgaccattgctacacaggcaggtgccaaatattacaacttaagggctgtcgaaccttatgtggattatgtcaatatcatgacatacgatatggaggaatctcctaatcaccattcggccttgtaccgttcggaaatggctgaggaatggtcttgcgaggatgcggttgccgcccatgttgccgcaggttttcctgtcggacgcttggtattgggtattccgttctatgggcatgggactaatgaagctccagaattattggattatcgtcatattatcgctttggattctttacagagttgttgggatagtgcggcacaagttccttatatggtaaattcgcaaggacatgtggtcgttaattatgaaaatgcccaatccatcgcattcaagtgtcagttcctgcatcagaaagggatgctgggggctatgtactgggattatgatagcgatgatgaaaagggtacattacgccatgccgtctatcaaggtgtaatgaatccttgactctttcagcttattttttctttatctgcatatttcctgtagagaggataagccgcttgcagtattttgttctttaataaaggagaatagtcgggataaaccgataaaaaagtttctactgctttgtaggtcgcttcgctatcgtgattccttaataaagccccgacccaattgcgggggaaaaagatatctccggtacgttgaacctctgttagttcttctaatgccggacggatatatttcaccgcataatcctttcttgtagaatgattcagatagcttaaggtcgtagctgcccagggctcaatccttctgttttccgcttgcaataaagattggaacaaactgtccaattttaaagtatcggcagtcatcgcacgtgatatgaaatcgaattgacgtagacggtccggattgtggatgcgttggcgctgtgtcttaagtatttcttttccttgttcaggtatacgcaaggccagttcgtaggccaatgtagtgtaatctttttcatttaattgttggactctttcggtttcccataaggaataaaggcactgaatcatagccggacttgctgtttctgtaattagaaggcgtaataactggatgcgacaagaaggaatcggatgagaatagctgagtctataaagctcattttctattttatcacgttctaccgaagatgtctcttgcagaggagaggacaagtaattggttaatgtcgaagctatcaacgggttcttttcacaatgtattccgttgagtaatgcattcatccatgtagtattcggaattctttttgcttgataattttcatgcatcatcattaaaactgcctgtcgggttgtttcattgtctatttcttgccaatgttccagcagccagtggagactgttgttgtcaggaataaacaaaccatatcctcttccgtccgtattgggcaaaatacgggtgggggtaaagggtaacgtaatacggcataagctgtctgtcaggctagcttctatcgttgtgtctcttgttccgcaaagggtgatattgaatttttgaggccagtttaatcctctttgatatgggtcttgctgatgtatggtcagctgtttgccggatacttcgaaattgattatcggcattcctttttggtttacccatacatcgctgaaagcggttagatcttgctctgttttactgtttagaatttgtatcaagtcatcccaagtagcgttggcgtaagcgtaagtttttaaatattcttgaatcccttcccgaaatgcttcttttcccattaattccaccagttttaccatcatgacaggggctttgttataaatgatctgtccataaattaatcctgcattttgaaggttatctagcggttgccggattgcagtggttccgggtgtacggtcttctgacaaggatgcggctgtataagtcttcatccaattcagctggtgattgacttgtgggaataatggttcggtaatcagagctgcaaaataattggcaaatacctctttagtccagacatcatcaaaccagttcatcgttactaaatcgccgaaccacatgtgggcggtttcgtgggcgattaattgggttcggcgaagttcttcatcaggagtgggattttcgcttaggaacatttgcgtgtcattatataaggtggcgcctgtgtgctccatacctccatattggaatcccggcaagataataaaatcgtatttggcaaaagggtaggggacattggtgtattcttccagccagttcagcgaagcggtcacttgtttgaagatggtatctaattgggctacttttttagaatctgtttcgcggtagtatgctgagattttccgattgccttctgtatattcttgatgttctaatttaccggtgacaaaggaaaagagataagtgcttaatggttcagttggggcaaaagttaccgttttgcagttgccttttgtttcttctttagtaatataggtattggaaacagctttccatgctgttggtatatccagtcgtagggaaaatgtggctttcagattcggctgttcgaaacaagggaataaggtacgggcacggtcgggcactaatagcgtatacagaaattcatcatttctgtttagcgactggttgccggcaataaatttgatagtgatattatttttgccttctactatatttttttcaggtaggatgatgtgctcgttatggaattcataacgggcagtttgtccattgacggataccgattttattttttcaggcttttctctgaagtcgagaataatttcttgcggtgcatccagattaaattcaatggcaatctctccatttaccggaactgatttttgttcaggaatggagaaatatagcttatatttcaactctttaatctcctgtttgcgcagtattgccagttcttgcgatacgccctcgtcgtagaaacgaggattgcttgttgtctgttggcaactgcataataataagttgcacatgacaataagatatccgatatatgttttcatcatctaaaatttatcttggttatctgctgcaatttttcggatgccgcgctgtgaagctatgaatgcacctcctaatactcgtttcccctcgtaaaaaacggctgattgtccgggagcgatggcggatgcttcggaaaggaaacggaccaatagttgtttttcatctaatacgagcacttgacatggaataggcttgctgcgatagcggatacgtactgacaagtccttgcattgtagtaaatcctgcatttctgtgatatgatagtcttctaccaacatatattctgctttaagttcctcggcgtcccctaacatgactgtattcttttctgcattgatgcgtagaacgtatgcaggatgccccaaagcgatttccaaccttttccgttgacctattgtataataaggaaagcctttgtgctgacctatcttgactcctttactatttacaaaccatcccggtcctacttgggtgtcaatatccgggcattgcgaacgcagaaagtttcggtaatccccttctataaagcagatttccatactttcacctccacgagccttcgcttcgaatcccttttgtcggagatattcccgtacttcctgcttggtataagttcccaatggaaagagaaaacgttgaagtatctcctgaggaagtttccatagaaaataggattggtcttttgtctgatcatctcccgctacgatatacagttttcctttccgttcttccagtctgcaataatgcccggtagagatatgagcacaattcgtttggtccgcccattcacagagaattcgctctttgaatagcggattgcaaaggacacaaggattgggagttcttccttgcatatactcatcaatgaagtgttttacaataatctgtttgaactctttcctcacatcagctacatggtgttctattcccagccgttctgccaaggcttttgcttccagcacatcatcaggttcatcttgaccgggggtggaaaagcgggaagggacatcccacgttctcatggtaactcctaccacttcatatccttgttcttgcagcatgatgcaagtggcggagctatctattccgccactcattcctaccaagactcttttatctctgttattcattatataaatagttcaggttcacggcgtgccgcacatttttggtgcagcatgggagtgtaaggagtatcaaaaactcgtgcaccattagggcattcttttacgcaagcgcagcacttgatgcatttggtaatctctgtttctatttttccttcatcgcttaaagcaatggcatgagtaggacatacttcgatacattcgccacaggcaaaacattcttctgtgcaaactggagcggcaggagtagaggggcctacaaagcgataaggtatatttccttttatgtaaaaatcggataatatttcatctttctccagttttgtcagacagtctttcccaaattgttccgcagtctgtaaatcggtaatatccggacgaccttctgcaatgggcatgttaggacggctataactgtgttcaccaataaaggcaccggcagccagtggagtgaaccctaattgaatagtttcatctctcaattcgactagtgcatcttcgtaatcgcggttaccatatacagtgattaaaatagccggagcattgttgcctcttaatcttcgtagccgttgcaatgctattggggctacccttcctgcatacacaggaactgcaatgatcgtgatagaatctttgatttctatcgggctactattctcatctgtagtgagatctatttctattcttttgcccatacctatacttcctccgatggcacgggctattttcgcggacgtatgtgtaggcgaaaaaaatatgatgtgattgcttgtatatgttttcataaacgcaaatatagtgacttttgtccaaaggtaaccaaatatatagataagatgtacaaggatatcgaagattattgtaacatgggtgtaaaatatgattggtaaaatggtattctgtacctttggttaatagaagtgatataatagattatacaggttaaattatacttagttgtgaacaataaaaagcccctgtttaggacgattaaaagattttttaaccggaaaataagtgacatgattttatgtgatgattgttaatccttactgacttgagatgttatataaaaggagagtgttagatttttgtttttctttttatagagaataaagtgcgtttcatctgttataaaccttgctttgtcgatgttatttatactattatatataagatatataatgaaagtaattactgactttaataggcttttaaggctttctatagttgtttgtgaggtaaagaatatatagatattcctatttcttaaaatattcctgtattttataaagatttttagtggaaagtcttgcagaatagagtaaaatgggtacttttgtccgatgaaattatggctattatagaaactgactaaaatatggatgctctatttcaaacgcaaagcaatgagctttctactataacgcagaaagaaaagctgtttaaagatgcagaacggcagtggaatacactgtcttccgagaaaggagcgcccggaagaaaagttgattttgagatctataaaagcattttgtataacctagaaatcagaaaagtatatttggattcaaagctctctttagaaaagtttagttcaatagtcggcacgaatacgacctacctgagtaatgcggtgaacaactacttcggatgcaacttcaagcagcttcttaataaatatcgtgttgagtatgcaaagtccttattactagagggtacgtattcaaccagttctctttttaggaagtgtgggtttgcatcccaaagcgttttttatgccgcatttcataaagtggtcggcgcatctcccttgcagtttctatataaagcaccatccaaacgcggaaaaagatttaaagtccttttataacaataacattttgagtttttaaatttataaatttaaagtttttctattatgaacaaaaaatttttaagtgcaatcctgttcggagcccttatggtcacttcaacaggaacatttgtatcttgtaaggattacgatgacgacatcgaccgcttggatcaagaaatatccaatgtgaaagatgcaatcaaggcccttgaagacaaagtaggctcaggcaaatatgtcgaaagctgtactccgttcactgatggtaatggtggttatgaaatcaaattcagtgatggagagaccattaaattatacaatggtgcaaaaggagaacaaggtgaaccgggcaaaccaggtactccgggtacttctgctgatgattatgtagtatcagtagaagaaggtgaatcagcttatgaattagttattacttatgctgatggcactaaaaagactatcagtatgcctaaagctacttctgtagttagcggagttaagtttatccctactttcctttctgaaggtgaagctgccagaatccatttccctaccattgttactgatagtgtggcaggtaaaacagagattgcaggtgcagattggagtgaaagtaactttaatacatttaaaatcgtttactcaggtaaggcagacgtgaagtatcaggtaaatcctaatagcgtatcattcaaggatatggaagtggtaggatttgttcgtgatactgctgaaatatggaactacaatacaaataacaagaattgggaattgttcaatgccggacaaaaactatacactgatggaaaaatcaccgttgattcttataaagaaggacatggtatgttaaacttccgtgtaaaggattgggcttttgctgagcaatctaatctggacgaaagaacagtatattcattgagaattaagaacaatgaccaaatcgttcattctgattttgttcccgccaagcatgaagtaattttgcagaaaaacgtacatttggttaaagtcgctgatgcatttgaccaaactaacgcttctgctcagattaaaaatgcaattgctcctaacaaggtaaattatagagaattcatcgaagatgaatattatcttaacaccttgaatccgactggtactgaagaggctaaattaaaagcttatcaagcagataaagccaagttcgaagccaatgctgaaaaccagttatataagggagatactgaatctaaagatgatgcaaaccgtattgttgtagaactgaattacacgggcgatggacattcaaaagatttaagagatatcgtaacttctttctttgataaccgtagtggaaaagccaaagatgctcagtatcctttgatggataatggttttgatgactattcattggtgtttgaaccggttgacttctactatgatggtgttaaccagactaaacgttacttggaagttaccaaagatggtgttgctacagtaaaacaaactccggacccgatttggggtgcagaaactgatgccagtcacacagctgctatagacagaactcctattgttcgtgtgaaactggtagcaccgggtgaagacaatggtaatgtagttaaaacagcaatcatcaagattcacattgtacgcaagacagttgttcctgaaattaatgttacagaaacaaaagatgtcactctgaaacatatcaatcaagttcttgatatggatatggataagatattcaaccataaagatgtacagttgagcaaagacgaattccgtaagacttatgagtttgttcctgaatttgcgacagcagacgaggctaaacaacacgctgtatatgcatgggacggaaaagataataaagactattcattagatccgaattttgttcctgaagaatataatcagctgttcgttacagtgaagaatacagcattctctcgtcatgacgatcacgacgtttacactgttaagggtacatacaagccaaatgctgatcataagggattacctgacatccatgttacttatactatcaatgtgaagtatccgaatgtggttgctcctgaaaagaccaagttgaactgggtagatgattcttacttcattgctcacggtagatatgataactttgatgctcctacaacttatgaaatggttgcagcattgaatgacgaattcgatttgatcaactataatccttataagggtcagactcatgataaggattgggctagagctaccttgtcattcgaattggttgaccagcataataatgcatctaagatagctgacggtcacaattccggtatccgtttgtatcaaggtgaagacaacaagtggtatatcgctttggaggcaacagacgcaggacgtgcttggatcaatgctgctgacgctaaggatttgaagaagatcaaaatgcgtgctgtagtaagcttcaatgaagatgttgacggattgtatggtacttgcaacaaggaagccaatgctcataacaaatatgctaaagaagcttacaataacttctcttgcgatactatcaatatggtaaacaatactccttgggctaaagatcatactactaattatactggtgctgctgctcctgaatctggacgttctacagtcgttatcgatgaatttgaagttgcatttgtaactccgatggtattccacgcttacgaagcaggtcctttgtatgacaagtaccaagaagctgaaaatacagtatcattgaaggatgcattcttcttgtcagattatctgtggtctgaaggtgctcaggcacaattcaataacaaccatgttatctatgaccacaaagatatggctgagaataatactttggttcaaactggtaataatgcaggctggtcacagaaactggtagttaccaacaacgtattcgatgtcaatacaacagttaacttccaggtttctaaggcatactttgctgatggaagtgaattggatgctgaaaacatgaataagatcaagcttgataatactaagcagactatcacatggattaacaatggtgaagatattgcccaaccgtttactattgatgtagaagtttgtgtaaatcacaagtggggcggtatctgcgagcatacttggaagggagatctcggacattctgtcggaactatccaaattcaggttaaaaagcacaatgataagtaattaatacgctcattgtttatttaaaaagaggggggcaaaatgttcccctcttttagtctttacaatcgtttatccaattatattgtgtatgaagtatatatatgctgtctgttttctgttattagtatgtggctgtcataaagaaaatgacacccccgttgttttacctgcacggacactattggtttatctgggaggagataataatcttgatgcggaaacctatgacaaacttgttcaaattaaaaatggatggcaagacggaacagatggaaaaataatagtgtatcaggatacaccatttaaggactctccacgattgatggaaattgatggaaaaagtgagaaaggctatattaccatacatacctatgatcaagagaactcagcctccccccaagtgcttaaacgagttataaacgacgtaactcggctttatcctgctaaaagctacggtttaatcgtattttcccatggcagtggctggcttcctccacatacattggtcaatggctcacggtctatcatcatcgataatgataatgaaatggaaataacagattttgccatggctcttccagaccatttatttgaattcattatctttgaagcatgtaatatggcaggtattgaggtggcttatgaattaagaaataaagcagcatatatcatggcttcctctgccccagtagtatctccgggattcactcctatctatgccggcagtatttcctgtctgcttgaagaagctgctgatttgcaaagattcgcagaaaattattttcattattggaatttgatggaaggcgataaacgttctgctaccattagcataataaaaactgccggattatcaaatttagcgaatttgatacgacagatcaatacagaaatatctggttctttcctcccggtcggtaaccttcaaaattatgatggagttttaaaagccccattctatttttttgatttcgctcaatgttatcaatcattatcagatgaaaacacatacaatgcacttcaagagtgtatcagccaatgtgtggtttacaaaagaaatactcctttttatgctacggaagaaggaacattccctatcacagcattttcaggtatgaccacttttatcatgcagagagaacttaatgacttaaatgaggaatatacaaaactacaatggtataaagatactaatacacattagagaatatgtaggataactttctatggaatgacatttggggagaaatcttttatcagttcaaagagataagacatatataaagatctactacttttttacatcaatagaatacaatttaattattataatatacagaaaattattagctcaaaggaatagaattaacagaagaaattattactaaacattgatgttactattcaaagaaataaataactaagatagttattctataagttaaaaggggctgtccctgaaaaacagcccctttatattatataccaattttaatattattcgaatgcaattgtagcggttgtcacaatgcctgcgaagtcagtgaatgttagaactaaagtacccttatcaccgatttgggtatttaccaatttaataccttcgctatctgaaacggcagtaacattattcaagccgtctacgccataagctactttaactttgtctgcagcagtagaattagattcttgaacagttacaccttcgattgcaggaatgctattgcatacagcagattctcccttaccatactgtaatgccaaaccattcttcttattattagcagtagtaagtttagcgatagtaaagtccgcaccaaccttagcagttgcaccagctacattattagtatagtaaaccaacttagcaccttcaaagatagacatgatcttagtagtgaacttagaagacttaacagtcaagtcatttacacctccaaatgtataagaagctacaacacccaattcattaactttcaaagtcttattagtattttggatattctgtagagttacagaagcacttgattggtttgctataacatccttattatccactttgtcaattgccaacttgatatcatttacagcagcctttgtattgggaaggaatgctcttgtgaagtttaccacaggtgtattagcaactgaagctgtcaaacgggcaacaaacttaccatcttcccaagcagttgtgttcttgaacagtttatcccaagcaggcagagcaactgttacaggaattgtaactgtcttgattgtgctaacggcagtacctgatttttgatccttgattgtcaaagtcaaattatagttacctggcttagccttagcattaacattaccatttacggcaatcttcatccaacggatattgcgagcatctgagttagctaatactacttcaccattatttgctgatccatctacaaatttatcagcaggtttaccatccttatcagtatagaatgttacattagtagaagtcaagtcatttgccaagaaattaacttgatctttaacattttcaacagtaatctgagttaacttattaatttcttcagcattagcagcagacaagctagagaaggcatccttcaaatctacaacaatagcatttaaatctccgctgtcatccaaacctaattcataagtagtagcggcgatagtttgagtatcatcagatttgacaccaccaatcttcaatgttatgtttttggttgtttcctttccgtcaacactcatgatatggacagtagcaatcacttcttctgcttttgcagattctttaatagacagattcataccattagcagaaacgcctaacttttcagcttttgctgtctgagtaccttcaaaagcaatgtaaccatcatagaacttagaatctgagcaaactaatgatgaagagccaacaggtacttcaatattactgttgttgtccagtgctttgttatgattgtttcctattgatttcaggttagttgtactcaaagtaataccatttccaactgttgtagcatttgtaatggcattatctttagccacttttacagcaattgtataatcggtataaactttaccattaatacgtaaagcgtacaattttgcattataggtggaattatcccatgcaccaaatacttttgtaatattatctttagtaacatcactcttcaaagtgatagctaaattccatttaccattagttgcagcagctctaggagcggttgcagcaccatcagtactattcggagtggcaacgatattaacgggagcgatatcaccttttgtgtcaattaattcaagtgtcatgcctgataaatccacactggcaggagtaacagataataatccttcagcaggtgctatttgtccaatcatcaactggttggctgcaatatttcctttgggtcctttccaatcaatctttccattgctcttatagccccaatcaagcccagttgcagaagaggtggtggtaacagctccgaatgttagatcgccaatcatgatttctgtaattgtagaagaggcagtcggtaatttgataaccttttcaccatcagcactatatactgtcaatgtatagcctgtagcttcagttccagtaacagtaataccagatacagggatatttgtattttcatattcacccttttcattcaaagtgtaccaatatccaccttctgctttgacaggagcttttgcagcatctttggcagggaaaatacctgtacctttaccatcaatcttcaattcaccagtcttttcatcaacagtaacttgctgagcatctttacccggagttccaggagcaccagcttcaccatcttttacatccaaagtaacggttacagtacttcctttagagaaagtaaaagtcattcctttgccatcagcagtcttggtgatacctgttacataatcaccattctctacttttgtctgcaaagctgccagctgagatttcaaatcggtcaacgtagcgttgatctcatcgatttcgtcatcatagtctttacaagatacaaacgttcctgttgaagaaaccatcaaggctccgaacaggattgcacttaaaaattttttgttcataatagaaaaactttaaatttataaatttaaaaactcaaaatgtttattgttataaaaggacttaattgcgttgaatcataaaaggattccgatcattcatgaggcaggctgacacactctgcattcactttccgcttccggcaaaagggacagcaaaaaaagaaaaatcatctggtagcccgtaaaagcacctcttggcatagacgcaaaagaaaggggcattgcgtcatcagtctaaacatcgtttaggcgtgaggcaatgcccttttctccggctatgcggtagtcggcacacgattgttcaaaactcgtttttggcaatggtgttccgacaaacaaaaccgcttttacggaaaaatcttatgaatgaggggataaaaaacgggagtttatatcaaaatctcgaattaaatagctacttttgcataggaagagttctttgaaggttacgcaatgcgcagaaagataatgcagtagataactaactaaatcgtaacctattactatcaagagcaattaacctacgctcatttccaataaattacactcttttcgtaacttctaggtacaaatgtacgatttgtacctcgaaaaaggactattttcactcggaaatttattaataaaagatataatgttaaactaaagtgcaacatctgttaaataatggaggcaattaactttattcatttaatttctttctacatttgttccattataacagaatgcaattgttttatgggaaaactgtatgtcgtacctactcctgtaggaaatttagaggatatgactttccgtgccatccgtgtgttgaaagaggctgatttgatattggcggaagacacgcgtacttcgggcattcttttgaaacattttgaaattaagaacgccatgcagtctcatcataagtttaatgagcataaaacagtggaaggtattgtgaatcgtatcaaagcaggcgaaactgttgctttaatatctgatgctggaactcctggtatttctgatcccggatttttgatagtgcgtgagtgtgtgaagaatgacatcgaagtgcaatgtttgcctggagctactgcttttgtacctgcgctggtgtcgtcgggattgcctgatgaacgtttctgttttgaaggattcttgccacaaaaaaaaggaagagtgacccgtttgacttctttacaagaagaaaaacggacgatgatattttatgaatcaccttaccgtttggtgaaaaccttaactcaatttgccgagtttttcggtgccgaaaggcctgtttccgtatgtcgtgagatttcaaaaattcacgaagaaagtgttcggggcacattaactgaagttatagcgcatttcactcaaaacgagccgcgaggtgaaattgtaattgtactcagtgggaaagaggactaaaaatgaataaacttaaaatgtaaagcaaatgaaaaaactagtatttttatcgttgttatctgtagctttattgacttcatgtggtaatggagctcagaaagatgccttgaaggctcaaaatgattctttgatggtggaactgtcaaacagaaatgctgaattggacgatatcatgggtgctttcaatgaagtacaggaaggttttcgtcagataaatgaggctgaaaatcgtgtagacttacagagtggttctattcgtgagaatagtgctgataagataaaagaagatattcgcttcatcagtgaaaaattgcagtcaaaccgtgagcagattgcgaaactggagaagcaattgaagaatagtcagtataattccgctcagttgaagaaagctgtagccaacctgacgaaggagttggaagctaaacagcagcagattgagactctgcaggctgaattagcttcaaaaaatattcgtatcgctgagctggatgatgctgtagctggtttaagccagaatgtaagtgaactgaccgctgaaaatgaagcgaaggctgcaactgtagccagccaggataaagctttgaatgctgcctggtttgtttttggaacaaaatctgaattgaaagaccagaaaattcttgaaaaaggtgatgtcctgaaaagtgcggactttaataaggattattttactcagattgatattcgtactgataaggaaatcaagttgtattctaaacgtgctgaattgctgactacacatccggtaggttcatatgaactagtgaaagatgcaaaagggcaactggccttgaaaattacaaatcctactgaattttggagcgtatcacgttatcttgttattcaggtgaaataagagaatttaaattattgttttgtgaaagggttgtgccgtgagtgacgcaacccttttttaatctgctttatgttgtatgtatagaagtatatttattgatttggatgatacagtatgggcttttactgaaaacgctcgtgatacattccaagatatgtatgataaatatcattttgatcgttattttcgttctttttctcatttttataccttgtacagcgggaagaatgaggagttgtggaatgaatatggtgctggtaggattacaaaagatgagttgaatgagcaaagattttcctatccgttgttgcaggtaggagttacagataaagcgttggtaaaagcctattcggataatttttttgatgatataatttacaagaagaaactaatgcctcatgtaagagaagctttggaatatttggcatccagttataatctgtatattttgtccaatggattcagggaattgcaggaacagaagatgcgttctgccggtgtggaagggtattttaagaaaattgttttgtcagaggacataggagtacataaaccgtttccggagattttttattttgccatgtcggctacacagtccgagctacatacttctttaatgattggagataactggaagaatgatgttgaaggtgcgaaaaacgtagggatgggaaatgtttattataatataaaaggtgagaggggcttgccttttaaacctggttttgatatgagggattggcaggatatcgcttctttcttatgaaattgaatggaagatgttgatggataattctgttggcacaaacaatgtatttgtataaggagtgtcaggtatttgtttcaaagggatgctcctgtgtattggaacatcccttgataagcatttttttctttcaactccttcctttaaagattatttgagaattagcggagttgaatttttatttagtaacctggattttgttgagcttttaaaatagggttagcattggtttcactgacaggtattggtaaaatcgctctaaaataagaacggtcgaatacttgtgattctttatttatagaataatgccaacctttctcatcttcattggtataacgtgttattgtttcattattacgcatggcgtcaaagaaacgttgtccttcacctactaattctttacgacgttccaataagactctttctagagtagcggtagactctgtaactaattgttttgtatcatctgtacggtttttaataatttcattcagatatttaactgtagaagctttgtcattcaacttagctgcagcttctgctgcatttaaatacacttctgacaaacgaagaataggtaaattgtttaatcgcatatcccctaaacttcccattgggaatttattgataaagatacgattgtctccataggtcttatacatatcggtcggttttccactgtcatctgttttcaattgtaccggcagaatcacatccaagcgaacatcacttggatcttgagctaacatatcaacaaatgattttgtgcaaatagcatcggcatatccatcttcatgatataaatatgcaataccttcacggtctgcccagtcgtcagagccgctattgacaagttcaaaaatcatttcattgatatgattggcgttgtttttatcccaagcgtttgcatattgagcctttgtccataggctataaggagaattttcgataatgttttttgctatatctaaagcctcctggtttttacccatgtatatatacacgcgtgtaagtagagctttggcagcccattcgtcaataaatccttgattgtctccagctgatttagaaacatttaaggctttggagtcaatggcttcggttaaatcttttacaatttgggcatatacttcggccactgtattacgtccgggaatagcactggcattcaaaggatctatcggggtggtcacaatgggtactcccattgaagctccataatcaaaagaataaggcataccatatacttttaccaaatcaaaatgtaccaaggcgcgaacagattttgcctgtgcatagatgttgttcacatttgcctgattcttttcggcatctgttattttgttattttctacggcttctatcaaacggttggcacggcgtaatacattgtattgtacattccacatgttgggagcatcgtcaatggtgtatttcatttcgtaacaactggaagagcgcattccttgtgtacgtgcctgcatgtcatctccccggacgtcaccatagtaaaacatacgtgcggcataatactgtgtataggtagagtttccctgcagaccatcatacataccatacaaagcggtttttgcatcattgtaatttgtgatggcagaattactgggaatactatctgatggtgtcagatctagccaatcgtttacacacgaagtcaatgcaatggttgccatcgtgaaaactagagatttatatatttttttcattttgttctctttattttttagattatatgttgaataagatttctggataatggaattttaatatcctgtttcttattctgtataaactttataattaataaattagaatccaacttctaagccaaatgtaatggttcttaaagccggtgtttcaaatgtacatagtccatcaacgggtgtttccggatcaacatataaaccatctgatttccatgtcaacagattgtttgcagaaacgaaagcccttaatttgttgattccccacttttgagatactttggaaggcatagtgaaacctaatgtgatatttttgatgcgcaaatgatctgtagacatcaaccaacgagatgatgcgatattagtatttccatatgcaaactgaggtaatttagcattatcgcccggttttttccaagtgtcttctattttgtaataagcaggtacgttacccaaataattatatgtacctccgttagattgcaaccaagtcgcatagtcataagcatggcctcctaatgagtaggttaatgtcatattgaaatcaataaacttccagcttacaaagtttgtgagaccaccctgtacggtaggttcaactgatcctatgattgttttatttgcttgtgcggagttggtagttgtctctctgcttccatcttctccgtttatataatataattctttacctgttgcaggatcaactcctgcatattcataagcataaatagaatagtatggttccccaatacgatgaatggatacaccgctaatcatttcgttctgttcaccatccaactttgttaatttgtttttattgtggctgatgttgaatgtggtagtccatgtcaaattgttgttttgaatattcgttgatttgatttcaaactcaaatccccggtttctcattgagcctacattcatcaatgtattagcaataccactcccgtcaataatgccgggtacagcagatatagctctatccatcaacaagtctttagtttcacgattgtaccattcgaatgttaaagccagacgattccacaaagttaagtccagacctatatttgttgcatagttcttttcccatttcatattaggattctcgatacgattttctgcagaaccagctcctttattataattgtatccaaatccgaaaacacccaaataaccataataatcagatggctgtgtaccatttacaccgtaagaagcacgtaacttggcatcagtaattacttcttttatattttccatgaaagattcactggtaattctccacgaaccggatacagaccaaaaatcaccccatctgctttctctagataaacgtgaacttccgtcacgacggaaactggcactgaaataatatttattttcataatcatagttcaaacgtcctagaaatgatgtcatacgatatctttgtacactgctggatgcacgggtattacctgcattttctatttccggcagataagatggataggtgtttccgttagcatatacataatcatatttgtaatcttctgtttcaaagccaattaaagcgtctaaagtgtgcttttctgcaattactttgttatatgtcaattgagtttgggtattcaatttcgcacggtttcccataacacgctggtaaactccattagaagaacgtccgtcatttgagcggggatcccaccaaacacgttcattgttttgattgaaatcataactgactacctcttttatgtttaagttgtcccaaatgttccatgttgcagaaagagaacctaaaaaacggtttattgtacttctgttataattataggcttctgtttgtataggattggcaccatttaatgccgggaagtttgtgctgaaagaaccatcttcattatacggatatgtagaaggagaggcagtcattgcatagcacatgatggggctggcaaaactggtcccttcgttgtttacgttttgagtggagttggtaaacattgtgtttgcctccagtgtcaaacgattggcttgatgagttacattggcacgtccggtaaagcgttcatagccggaaacgtttgtaataccttcctgtttagtataagcaaaggaagtataaaaacgtgttttttcgcttcctccttgtgcgcttacttcataattttggtgacttccgttgcggaataagacgtctttccagtctgtataacccgaccatggtcttgcggcgaagtcttcaatattcttatctgcgaaggcttttgcagctgcttcgtcattaccattgtttaatgcatagtttgcaagtcccagatgtagtatttcacgtctgtcttctccatttaagatcggacggtagttaatggccatgttggaaagtccccaatctgctcttaaattgatttttgtcttgccggatgccccttttttagttgtgataacaattacaccgttggcagcacgagaaccgtaaagtgatgcagcggcggcatcttttatcacggtcatagattcgatatcgttgctgtttaatgtagccataaggctgttacctgaatctgcgtatgagaattcactaacattgccattcagcatagggactccgtcaataacgtacaatggctcattgctggcattgatagaacccataccacgaatacgtacagaagcgacagctccgggttgtcctgaagttgatgtaatttgtacaccagatacagaacccgctaaacgatcctgaacactaactgtagggatatcttgtaatttctctgttgatacattagaggctgatcctgtaaatgatgattttttgaaattaccatatcctgttactaccacttcttcaagcacttcggcatccgacttcaaagtaatattgacagtctgttttatagccacttcttgtgtagccattccgataaaggaaactaccaaagtctttgcagaacttggaacatttgataatgtaaatttaccatccatgtcagtaactgtacctacagtggtaccttttactaaaatagaggcgccaactacgggtaatccgtcctcttccgaaataacagtacctgttactttcgtgatctgagcggttaccaaacctatacctacaaaaaggcaggtcaataacagcattaattttcttttcataaaattctctcttaaagtttaactttacattaatataaattcattcactctaacaaattgcaaaggtatgaataaaattgtaatctcaaacaaattattgtaaaaatcatactaaactgctatatttttatgcttttgggcatttaaaactcacaaaaaacgaaaataaacctcatgtttattctttttttaaagtcgtaagaaaaagagagtttcaaattataactgaccatataaacatacattaacctataaacgttaacaaatcgcctaataaatataaagatgagaacaaaatagcagaataatgcttttctacttttctttattgcgtcttattatagaatttcaatttaaagaattaaattatgaggaaaatcagttatcgtttcgtttacaatcgaaaaaaaagtttaaatgacagaggaactgctttagttcaagttgaagcttacttgaataaaaagaaagtgtatttttctacgcatgtttatttacggccagaacaatgggatgtaaaaagaaagattattaaagagcatcctaatcaagatgcactgaatggcatgcttaatgaatttattatagaattagaaaagaaagaattaagtttgtggaggcaaggaaagacaataaccttaagcctcataaaagaagagttcaaatcgaacacagatgcttcatttttagggtttgcacgtaaagaaataatgtcttctcagctaaaagacagcacaaagcgtaaccatttaacgacaatatcccttttacaatcgttcaaaccgacaattgagtttgaagacttaacctataatttcgttacagattttgaaaaatttctttatgattccgactatcaaacaaatacagtagctaaacacatgaagcatttgaaatcttttgttaatgctgcaattaataaaggatacatcgatcctaataactatgctttcagaagatataaaattaaaatgaaagaaggaaagcatgtttttttattaccggaagaaatgaaaaaattagaagaagtgtctttgataggaagaaatagttgtttggaacatactcttgatgcatttttattttgctgctatacgggattgcgttattctgattttgtaagcttaaatgagaaaaatatcgtaaaaatggatggaaaattatggctaatctttgactctgtcaaaactggtgcagaagtgaaattgcctttaagtttattgtttgaaggtaaagctttaactttgttacaaaaataccaaggaaaatggagttcttttttttcaataaaaaataattcaagcgtaaataaagaattgatacgaattggtaaattggctagaataaacaaacacttttcattccactctgcaaggcataccaatgctactttattgatatataaaggtgctaatataacaactgtacaaaaattgttaggacataaaaatcttgctacaacacaaatttatggagaagtaatgggaagtacaatcgtacgagatctaaaaaaatgtcaaaaaaggtagtaaactctattgtctatacaatatttcttataaagacgaggaagggtcattttcataagtgaatgtagtcttatcttcttaataaagtttatcgttttgtgaacatgataaatttttgttgtggttgcaatacgataaactaaaagaaataaaatgtgacaatattcatatcttggcataactgggtagaaaataggtaccaaagttcttgaatttctgcaagaatcatatatgtataccatataatattcatatataaaattttgcatcggaaaatgatgataatagtttgccactttactttatgccccctgttttcttctgtaattcgaagagcaaacaatcttttggaagccttaaaatataaaaagaccaagaaatatcaactttggcaatacattcaatacataaatgaaagatataggctatccatccaaaaactttacttaaagctcaatgcttagaaattgtaggacattcttaagatctatataatatatatacgaattacagaattaataattttgtaataattatagaatcaaattgtaacttaagtaatatacaagtatagcttaaaacaaatagacctaaaatggataaattagaattcaagaataaaactaatcaaagccattttgactaataatatttgtcttcatttgatttaatataaagttatgtggattatgctctcgtttacctcactttttgtagagaaacgggaaaagagaaggatactaaaacagatatttatacacctgtatacatattgttctgtaaaacaaagatttagaatattatgtaaaaaacaaaaagtgagaacatggatataatgatacaacttaatattaattgttattcatagattagtattgtataaactcatatattagaaaaacatgtaaccttataatatcattttgtatatttaggaatgtgtaactctgtacgatataaaatcttcctattagcttgaaaagaatatttctattaatagtgaaaattttcgtagcactctttttgcacatattttctatttatacaggatgaaccttattaaaaagccaagattgttttaaagcaaagataaggggctcttttaagaacaaatttatgttatttaggggctatcgatatcttttcagtgaagataataaatttagtttcattttatgaacagggcagcggtgagtgttacaaaatgttatacgtctattatttctttcagtagaagaaaggtagaaaacaattattttcatactcttagaatggcttaaataaagaaaaacagataagactttagtgtattaaatactgattatcaataaattaaataactgattagttctgcaaagactttggtggtttcctttatcgggatggctagtcaagaggtttctatcaaacagaatgttagcatcattttaaaatctgatactaaagtgcttggagaagtgatggttgttgcatatggtactgcaaaaaaggaatcttttacaggatcagcatccgttattaataataagaaactggaattacgtcctataagtaatgttactaaaggattggaaggacagactacaggtctgttaacaacttcaggctcaggtcaacctggcgaagctgccaagatcgtgattcgcggttacggttccatcaatgcctcacaagatcctttgtatgtagttgatggaataccttttagtggagatatgagttctatcaatcctgccgatattgaaagcatgacagttttaaaagatgcttcagccggagccctttatggagcccgtggtgcaaatggtgtaattatgattactaccaaacaaggaaaagaaggcaagactaaggtatcttggcgttctacggcaggttggtcttcacgttccttgaaagcctatgacatggttgaccaaaaagaatttgtacagttaacgtatgaaggtttacgcaacggatatatctttgacaatggatataactgggaagctgccggtagacaagcatcagcagatttaggtggcgttttaggtggagaacaatataatccatttaaaaattacacatggggaacaattatagatcctgcaacaggtagagtgcagggtgatgctacatccgcatggaatgaatcttggatggatgcaatacaaagagacaatgcatttcgtcatgaacaccagttgtctgttaatggaggtacagaaaagaccaaatatatgttctctttgggatatttaaatgaagatggcatcttgattaataccggtttccaacgttataatgcccgtgcaaacataaacacagaagtgaataaatggatgaagactggattgaatgtgtcactttccaattccacacaaaatttcagtgattacgaaggttcatctaattcaaatgtgtggtactctgcacaatttatggctccgatttacccggtgtatataaagggagaagatggtaaagatgtattagatgccgatggaaatcgccaactggactacggtgacggtagtgtacaacgcccacagtatagtgatttcaatcccgtaggcggtttggtagatgacaaggctgatataaaaacagatgtagccggtttgcgcacatttttggcattcggctcagattcggaagatgccggatgggctaaaggtattaagctgactttaaactttggtctggactaccggaacaaatctcaaaaatcatatatgaatatgcaccatggtaatcaggcagctgccggcggtttgttgatgaaatataacagaagaacccaatcttatacttttaaccagttactgacatgggggcgttcttttaactttcataacatcgatcttttggttggtcatgaattttatgcatacaaatatgaatttctgtctgccggaaaaaccaatttagtagatggtattcttgaattgcgtccgggtacaaatctatacaatgcagactcgtattcggaagattatcgtgtggaatccttctttgggagattcaattataactttaatgaaaaatattatttttcagcctctatccgtacggacggttcttcacgcttccaaaaagataaccgttggggtactttctggtctgtcggtgccaactggagaatttcacaagaaaagtttatgcagaatttgacttggatttctaatttatcagctaaaatcagttatggtgaacaaggtaatgataatctgttaagatatgatagtcttgaaggaggatatgtaccggattattatccttggcaaggactctatccattggaatatccgaatgccaatcaagtaggaggtctgatcggtgctttggaaaacaaaaaactttcatgggaaaaaagcggtaatttaaatgtcggtattgaggcaagtatgtttgacggacgcttgaatgttagtgctgaatattataaccgcaaaacaacggatatgttgctgggataccctaaggctacttctagtggattctctgaatacaatgcgaatatcggttctatgcgtaataccgggtttgaatttagtttaggtggttcccttatcaaaaccactgattttatatggaacttaacttggatgggctctactgtaaccaataaagtgctgaaactaactggggaatctcctgaaattatcaagggagttttcagtattaaagagggaatgcctattaatacatattatatggctaaatctgccggtgtggatcctgcaacaggagcgcagctctattgggtatatgataaggatgataatggcaacatcactaacgaatatatcagcagtgactatcaaaaagctgcgaacagcaaatattattccggcagccgtatacctgatttatatggtagtatcaataccgatttctcttacaagaatttcgatttgtcaatattgggtacatattctataggaggtaaagtttatgattcattatacgctggttctatggaagttatgtatgcaggcaatacatggaacaaacatgctttgagacgttggcaacaacctggtgacatcacagatgtacctcgtattcaaattggaggttcctacacagcttcagaccgttttttagttgatgcttcatactttgctatcaaaaatatcactttgggctacactattccccaacaatggctaaagaaggccgggctagagtctgtccgcatattcggatcggtagataatctcgctttattttctcatttggacggtatggacccacagtataacttcaagggcgaaacagactattcttatgctcccaacaagacttattcagtaggttttgaaattaatttctaacaatttaaaagaatacaggaaagtatgaaaaaaatatttaaatacatatttgccgggatggctgcaatgtctgtggtagcttgcagtgaggatgctttggaaaccagtccttcatcttctgtttctggcaacgaattattaggaacagcaactaatgcattagtatcattgaatggtgtatatcgagcaatgtatacagcaggggtttcaaacagctctaacactcatcaatgtttcggtatcacagcttataatctggtggcagatgttatgggtgaagattgcattatgaacggacaaggtagcggctggttttggtatgattgcgtttacaacgtaaaatcaagatatacctctaccggatggcgttcttatgatatgtggaatggctattacacttggatttctaatgtcaattacattttggcagaagaggaaaccatgtctggaagtgaaaccgaaaagaattatgtgcttggacaagcctacgctgtacgtgcttacagttattttatgctggcacaaatgttttctcgcacttataaaggacatgaaagcgaaccttgtgtaccactctatacagaaccgactgatattgcaacagaaggtaaagggcgcgcaacggttgaagaagtatatcaacaaatcacttcggatcttgacaaagcaattaccatgctgggcaactcaggtaaaagaaaacatatcagccatatcaatgaggctgttgcctcaggtataaaggctcgtgtcgctttagtgatggaagactggcagaccgctttggatgccgcgaatgccgcaataagcaaaagtgggtgtagtatcggcactggaactgcggtaaccggtggaatgaatgatgctactgccaataatgtgatgtgggcggccgaaatcatagccgaccagtccggaatgtatgcaggtttctttacacacatggatgcggatcaagggaaatatggagctagtgctcgaaaacagataaacaaactgctttatgcaaagctaggcacaaatgatgtccgcaaaaaatggtggaatccacaagacgagaataatgaaaagaatggttaccaacaagaaaaattcaagtttaaagattatgcgaaatggacgggtgactatatttttatgcgtattgaggaaatgtttttaaccgcagcagaagcatcttgtcgtttaaatgatgacaaaggcgcacaactgatgttgaacagtttaatgcaaaaacgtgatgaggattacacttgcaaaaaaacaggaacggcattaggtaagctcacctcagatgaaactggttctttacttgaagaaattataattcaacgccgtattgaactttggggagaatttggacgtatctatgatatacgccgtctgaaacaagggttcagacgtactgcagacatgggctggccatccagtgctttaattgctggtacagatacggaagatcctgagtcgtatgcatgggtattaactattcctcaaacggaatttgatggtaatccgaacatggatcctagcaaagatcagaatccgataggtgatcataaatagtattaatctgtaagcaagtaaattatgaaagtaaataaatatataatcggcatgtttgttgccactgcaactttttttgtatcgtgcaacaccgacaatgaaggagatatatacaatagcacaacaatgggggtgacattcgccacaggcacacaatcggtttcctttccttccacaggatatgagggttttgatgtagaagtcttacgcgcgaaatcttcggaagctactacaattaatttatcagcaacattagttgtcggtgataaagagcaggaactccctgcctccattaccgtaccttcctcggtttcattcgcagcaggggaatttaagaccaatattcatgttacagttggagatataactcctggacagaattataaagtcaagatatctttgccggaggaaatggttacgatagaccagacttcggataaagtcataactgtttatagggattatactttttcttcattaggaactggaacatttaaatctgcggctatggcagaggaaggagaagattttgcaacttgggaagtggaagttcaaaaagcagaccagatatcatggtataaagctatgaacttatatgaaaaaggatataacattgtcttcaaagttaatgaagccaatgaggtcactgtagaatctcagccggcatggaagcacgcatcctatggagaagtttttgtttcaggcaaaggtgctttggaagacggggttattactgtgaagctgtcgcatgatgtacccaatgttggtggttttggtgaatttaaagaaatactttacctacctgctaaataatttagatttaagatatgaggaaaagatgaaactttctccttaattatccaataaattattacccaagtatacaaaattaatgtatacttgggtaaatctatatagtaaatcggtctttagaaattattgataaacatctgttaactcgaattcgattactatataaatgtgcttgtaaagacatatatgttaaatatttagttacatatttggaaggaacacaacaaaccaccatcaatccttatgaactgattgtaactcctgacgggaagtcaaattttgattacacacggaatcttccatcagtttttttaatgttcttctcagccaaaactcaaaaaaacgatcatagaccggatgtagcatattatgccgtcaaacagttgatatatttcagatataacatttttattaatgtacttcccgtttttctggaaatggtgtgtaacaaattttgtatattctttcagtctgatagattgtaaatccaaaatcatagtactttgataaaaaagccggaagacttataaaaatttctcccgtcatatgacattgtgaacataaatatataaatggacattgtacaatgttatatatagatgctcaaaatggctttaacgttctttcccggatattgagcgataacttgaaattagtcaatcgctactaggcagattttgtctgcttttcctagatagctaagtatttcgtccaaagtaacagacgttttttgctctctcccatttctaaattccaatttggatttcctctttcattatttcatgcattttttttgcaaaaaaattataatcttattataatacaatcattataatgagatttatcacaattagacttttttatcgtataaagtaattttgaggtagaacaaaagtagaaaaaaaggttatcataactttgtttaaagtaattcccgcagagtaaataaagagaatcgataaattttaatcttttgattataaacactttctgtgtcttgttagttctgcaaagactttggtggtttcctttatcggaatggctacacaagaagtggctataagacagactgttaatatcactttgaaatctgatacagagatgcttgacgatgtggtagttgtagcttatggtactgcgaaaaagtcgtcttttacaggttctgcgactgctgttagtggagaaaaaatagcaaaaatgcaggtttcttcagtttctaaagccttggaaggtgcagcagcaggtgtacaagtaatcaacaccagtgggcagcctggagaaaatgctaaaataagaatccgtggtattggctcttttagtgcatcgtcggctcctttatacgtagttgatggtatgccttatgatgaagagtctgttaatgcattgaatcctgccgacattgaaagcatgtctatattaaaagatgctgcatctgcatctctttatggttcacgtgcggcaaatggtgttgtgatgatcactaccaaaaaaggtatggtagataaatccaaagtaactcttgatgcacgctggggagtaaatactcgtggtgttccagaatatgatatcatgaaagatcaaagagaatacgtactaacagcttggaatactttgaaaaatcaatctacaggtgcagaagcttccgaaggattaataggtagcattgggtacaatccattcatcggtgtagctaataatgccatggtttcagcagatggtgtagttagttctgcggctctccgccataatgacgattgggctgatgccgcattacataatggtatgcgtcaggaatataatttgagtctgcaaggtggtaacgctaagacaactcattttttatcattgggatatttgaaagatgaaggaattttaaggcatactgacttcgaacgtatttcagcacgtgccaatattaatcatactgtaaataagtttattgacatcaatggtaatttggcttacgcaagagcggaaaaaaatgcaggccagtcacaaaatgctagtttgtctaattactctaatgcctttatgttcactcagcaaatcgctcctatttatcctgtatatgcgtatgacgaaaacggaaatcgcatatatgacgaagaaggcaacactgtttatgattttggtgatggtacatatagtacacgtatgggcggtttcagtaatcaaaatgttgcagctaactctgggttggatgtgcatcagactttgaatgacaattttaatggccgtggtactatcaacattaatattattgatggtttaaaagcgactgctaacattggttatgatttaatgaatcaaatccgtacagaccatatgaatcagttatatggggatgctgctaatgtgaatggtcgtacttataaatataatcaacgtattgaatcgtttacagcaaatcaacttttaacttatagtaaagcatttggccatcataatattgacataatggctggtcacgaatcttattcatatacactgaaatatcagtatactcataaatacaatttttatactattggaaatcctgagttcaacaatgccataactatgagtgatatgaattcatatacacaagaacatagtatggaaagtttctttggtcgtgtaaactatgattttgataacaagtattatctatctgcaagtattcgttcagatgaatcttccaaattccatcctgatcaccggcgtggtactttttggtctgtcggaggttcttggagattaacacaggaagagtttttgaaagatgtggaatggttgtctaatcttaaactaaaagcaagttatggaacacaaggtaatgatggaattcttgatataaatggttatgtagtctatcaaccatatttgaagcaatattctgtaaccaataataacggagatttctctgtagtcgaaacttatcgtggaaataaagatttgacttgggaaaaaagcaaaaatttaaatatcggtttggaagctgcttttcttaataaccgtttgaaactagaaactgaatatttcttgaagaagacttcggatatgttgtacaatatgccttatcccatttcttctggaatttcttacgttccaatgaacctgttggatatgcagaacaaggggattgaatttaccatttctgccaccccaattcaaacaaaagattttatatggaatttatcttttaacggtacacactatagcaataagattttgaatcttccagaagacaaaagagagaatggaattattcatggtaccgcttctttgttccgcttaatggaaggagggtctatttatgatctttatacgtatgaatatgcaggtgttaatccagagacaggagcggcacaatggtatatggatgagaaagatgctaatggcaaggtgaccggaaggaccgtaactgaagactatactcaggcaagcaaatatgaattaggttctactttgcccgatttccaaggaggtttttcaactgattttgcatacaaaggaatcgatctttctatagctacaaactttcaaattggtggaaagatatatgacagcatgtattcttctttcatgcatgcgggaagcaatattggcagcaactggcataaggatatcttgaatgcttggactccggaaaacaaaaatacaaatgtgcctataatggatggtgcgcaaaatagtaatagccaatcctcacgtttcttgataaatgcatcattctttaacatccgtaacatttcattaggatatactttcccgaaagaatggatgaaagcaatatcagcaagcagtgcacgtatttacgtatctgccgataatgtagctttattctctaaacgtaaaggtatggacccccgccaatatgcttatggatattcggctgccaattattctgcgattcgtactttatcattcggcattaatttgaacttttaaaagaatagaattatgaaatatacaaaatatttagcaatattggctgcagcgtttatgatgggatcttgtagcgatgactttttggacaaggaaccttcagaaaatgcatcagaggaccaaattaaagatttgcttgataaagatcctacagctattcaagcatacattacaggatattacaaaaatatgttttctccggaagcacagcaaagtcatgatgatttcgggttaaaggcatttgaattggccacagacttgatgggagatgatatggcgtatatgacttcacacttcttcgtatatgattatctgcttgacaaccgtgcttcaagttatcgtcgtactaccacttactggcaagaattatatgctgtaatcagtggtgcaaatgaagtaatcagcggtctgaaagaacaagcggacagcggtgatgagagtgttgagaagatgctgggacaaagttacactatacgtgcttactgctatttttggttaataaacatgtaccaacaaccttatgaatggaataaagataaattaggtattcctatttatactgaatctgaaaccaaattgaatcgtgttcctgtaggtgaggtctatgaacagatattaagtgatatagataaaggatataattatttgaaaggaaaaggaatatccaagaaagatgaattaaatgaatatgcagcagctgctatttatgcaaacattctttcatttgttaatgattatcccgatcaatggaatgaagttgctaaatacgcaaaattggctattgaaggtggctcactgatgagtgaaaaagaattactttccggctttaatgacctttctttgagcgaagtgttgtggggggctgatattaatggtgaaacgaatacattctacgcttcattcatgagtcaagttgatccttacggtccgggatatggtggtaatttaggaaattacaaaatgatttccagtgatttgtatgaaaaaatttcagataatgacattcgtaaaaaatggtttggagttgatttgggagaagcaaatactcattataaagtaagacaatatgtgcagcgcaaatttattgatgtaggttctaccgcgcctggttttactcctacaggtgatactttttgctctgactatatttatttgcgtactggtgaaatgtattttgtagctgcagaagcattatatagggcagggaaagaaagtgaagccaaaacaatgctgactacgattatgaaaactcgtaatccaaaatatgaaacatccgcaacaagtgatgcacttttacaagaaattgaacttcaaaagcgtattgaaatgtggggtgaaggtcgtcgtttatttgatatgaaacgtcgtaatgaaagtttggataggacacatgcaattaatcatagtgcgattgctccaaaggaagtccctgcaggtagtaaattattcatttatcaaatccccgataaagagttaaatgccaatagtgagattactgataaaaacgaataactaataataagtctataataaaaaagatgcctagtaatctaggcatcttttttatgcttaaggtagaataaaagtagacataaaatcaaattatttttttctttttataatatatagttgatttatagtttgttataatagacgtaatattgtatatctgtaagaaaacagaatgctaaaactttgattactagatgcttttttgtatattttagttctgcaaagactttggtagtttcctttatcggaatggctacacaagaagtggcagtcaaagcaaacttgaatattgtattaaagtctgatacagaacagcttgaagaggtaatggtggtggcttatggtacggcgaaaaaatctgcatttacaggttcggctgccactataaaaaatgaaaaaatagcgacgagacaaacttcaaatgtgacaaatgctttggcaggtcaagtagccggagtgcaaactacgagtaataatggtcagccgggcaaagatgctgaggtgcgtattcgtggtattggatctatatcggctagtaacaaacctttgtatgtggtagacggagttccgtatgatggtgaaatttctgctatcagcacttctgatatagaatcgatgacagtgttgaaagatgctgcttctaacgctctgtatggtgcacgtggtgccaatggtgtaattttgattactaccaagcgtggtaagagtggggaagcccgtgttacttttgatgctaaatggggtataaataaacgtggagtacctaattatgaaacaattacggatccggctacattctatgaattaaactattcttctatctataatgctgatttgaaaggatatgcggcagccggagacttggttaaagctaatgcgtacgctaatcaagcgatgctttcttctacatatttgggatatcaggtgtattccattcctcaaggacagcaactgatcggtatggatggcaaattgaatcctagtgcgacattaggttattctgatggtacatattattatattccggataattggtcggatgaaatttttgaaaataatctgcgccaagagtataatttaagtattagcggtgcgaccgaaaaaatgaattattatatgtcggccagctatttggatgataagggaattgttcctaactctggttttcaacgttattctgcacgtttgaaagctgactatcaagtgaagccttggttgaaaatgggaggaaatgtatcatttactcattatgatagccgtgaacaggatactgagggtggtacctcaaatgcaaatatcttttatgcgtcaaatattatgggagctatttatcctatgtatgttcgtgatgcacagggcaatattatggtagataatcgaggtttccttcgttatgattatggaaagcaaggacaagattcgaatggtagccgtaatactattcctaatgcaaatccgttggcaagttatatgttggataaaatgaaatattctggtgatgtggttagtggaaaatggtctgctgatattgatatatggaatggaatcaaggcaaaagtgaatataggtgttgatgtaaataatgtgcgttctacaaatatggttaaccccttctacggacagtattccgaaactagcggagtcggaggtttgatcagtgtagctactgagcgtacatttagtgtaaatcagcagtatttgttgacatacaacaaaacatttaatgatgttcataatgtggatattttggccggacatgaaagttatgactataaatatcaatatttgtacggacaacgtgagaaattgtacgatccgaatgttcctgaattaggcaatggtattatgaaccagagcaataattcatattctcgtaattatgcaacagaaggatggttgttccgtgcgcaatatgactatgatgggcggtattttgtttcagcttctttccgtcgtgatgcttcttcttgctttcacccggataatcgttggggtaacttctggtctgtaggagcaggatggttattgagcaaagagagattcttggaaaaccagtcttggattgatatgttgaaatttaaaattagctatggtttgcaaggtaatgataacttgatgttccaaggtggtttgtaccgtaactactatccgtatcaagaccagtatacattggcaaacagtaatggtgatttttcaacttctttatattataaaggtaataaggatattacttgggaaacttcacatagctttaatactggatttgattttgctttttggggtggtaagttaggtggttctgttgagtacttctcacgtaaaacaactgatatgctttatttcaaaccggtagcagcttcaatgggttattcccgctatcccgagaatgtgggttcaatggtaaaccgtggggttgaattggatttgtattccaatataattgaaaacaagaacttttcctggaatataaactttaatcttacacattttaagaataaagtcttggaattatctcctgaactgaatggacaattgattgatggtggtcggatttatcgtgaagacgagtctatgtaccagctttatttacctaaatatgtaggtgtggattctgagacaggagagagtctgtgggcgctggtgactccggatgagaatggtaatacagttacaaaatcttattctgtcgcttctgaaaacagattcgcatcaggtgatattctacctaaagtttatggtggttttggaacaagtgtcacagcctatggctttgatctctctgtttcgtttgcatatcagcttggtggacgtattttggactatacttaccaaggattaatggacgtagcagctacaggtagtgctttgcataaagatatgttaaaagcatggactcctgaaaataaaaatacggatgttcctcgtatgaatattaatgaccaatatacgaacagattaacagatcgtttcttgactagttcggactatttaagtttgcagaatattacattgggttatactctgccaaagagtctgacacgtaaaatgcagattgacggtgttcgtgttttctttgttgcagataatgtggctttgctgacagctcgcaaagggctggatccacgtcaaggttatgtggctgctgacaatgtgtattcacctatccgcacaatttccggaggtatatctttaaatttctaatttagcaacctatttttaagaatatgaaattgtcaaataaatatatagcatttgcaagtgtcgctttattaatggcatcttgcgatttggataaattccctgaaggagattacatatctgaagaacagaaagaagatataatcaatggcagacctaatttgataactgctgaagtgaatgctatggcagccaaattaaatacttttggtacgatttcagatgatgccactacttatcataatgattatggtattcctgcggtatctatgatattggaatcaggagggcaggacttggttgcattggttaatggatataattggtttaatacatctcagaattatagtgacagagtatacgatagttcaagcgatgaattgatttggaaaacgttctataatcacttgaaagctgcaaacaatgtactgaaattgatagcggcagatacggaagattcttctttgaaggtttatcgtgggcaagctttagctgctcgtgcttatgactatctgaacttggttcaaatctatcagtttacttatgcaggtcatgaaaatagtctggcagtacctattgttacagaaacaatgactgatgaagatatgcagaataatccgcgtgcaactgtacagcaggtgtatgaccaaattatgagtgacctgaatacggctgctgatttattggccgggtatgataatggctcaaacaaagatcagattgatgagacggtagtttacggattgcgtgctcgtgctaatctgttaatgcaaaaatgggcggatgcagctaaagatgcagaacgtgccatcgctggcggtacacctcagactttagctcaggtgtctactcctacctttaattcggcatcggcaagttcatggttatggggagtgatgattacgcctgataatgatgttgtccagactggtattatcaactggccttcgcacttgtgttcttttaccggaaacggttatacttcaggagtgcccgatggatatagaaaggtgaactctgcattatatgatttaatacccgaaacagatattcgtaaacaatggtttttgtctccggataataaatcttcattgattgataatgaacagattgagggtacttccatcgttgaatattttggtttgactccgtatgtaaatacaaagttcggagcttatcaaagtatatttggtaacacaaccaatgcatcagactggcctttgatgcgtgttgaagaaatgtatctgataaaagctgaggcagaagccatgggtggtaatttgagtggcggaaagagtacattggaaaattttgtacgaacatatcgggacccttcctttacaagtaaagctaattcggcacaggattttcaggatgaggtttggttgcagcgtcgtatggagctttggggagaaggtttctcactgttcgatatcctgcgcttgaaaaagccggtgattcgtaagaatacgaattatgacccgtctgtacaatataattcagctgcagaagcacaaatcctgatctaccggattccgcaatgtgaaatggaaaccaattccggaatcagtgatactgataacaatccggcggctccacaaccacaactatagggaataactgtaataaaaaagaggatgacgttcaacgttcatcctctttttttgttatatttgtcgcgaacttatttagattgatagataaatgaaagaatttgtaatttctgaagcacaggttgaaactgccattttagttggtttgattactcagacacaagatgagcgtaagaccaaggagtatttggatgagttggagttcttggccgaaacggctggggcaacagtggtgaaaaggtttactcagaaactgcctgctgccaattccgtgacttatgtcggtaaaggaaagctggaagaaatcaaggaatatattcatcaggaagaggaaaatgagcgtgaagtcggaatggtgatttttgatgatgaactttctgctaaacagatacgtaatatagaagctgaactgaaagtgaagatcttggatcgtacttcgctgattctggatatttttgccatgcgggctcaaacagcaaatgctaaaacacaagtggaattggcccaatacaagtatatgttgcctcgtctgcaacgtttatggactcacttggaacgtcagggaggtggatctggtgccggtggaggtaaaggctctgtgggattacgtggtccgggtgaaactcagttggaaatggaccgtcgtattattttgaatcgtatgtcattgttgaaagagcggttggctgaaattgataaacagaagtccactcaacgtaaaaaccgcggacgtatgatacgtgtagctttggtagggtatactaatgtgggaaaatctactttaatgaatttgctttcaaaaagcgaggtctttgctgaaaataaactttttgcaacattggacaccacagtacgcaaagtgattattgagaatctgccatttctgcttacagataccgtaggatttatccgtaaattaccaacggatttggttgattcctttaaatcaactttggacgaagtacgtgaagcggatctgctgattcatgtggtggatatttctcatccggattttgaggaacaaatttctgtggttgataaaacgattgctgatttggaggcaggtggaaagcctaccatgattgtttttaacaaggtagatgcttatacctatgtagagaaagcagaggatgatttgactcctaaaaccagggaaaatattacattggaagaactgatgaagacatggatggcgaaattgaatgataattgtatcttcatttctgctagagagaaaataaatatggatgaattgaagactattatatataataaggtacgcgagctacacgtacagaagtatccttataacgattttctttatcaaacctatgatgaagaataaatacatatagaaaatgaaaacttatcgttcacttacacaagaagaaatacaacaattaaaagagagatcatgcactgcggttgattgggctgaaattgaagtagtagagaactttaagacggactatatttgtcatacccgtttttctggaagggtcagattgggagtttttgaagacgagtttatgttggcgggtggcatgcgtaaacattccggattgtatcatgcgactttgcataatgtaacggtgggcgataattgttgtattgagaatataaaaaactatatagccaactatataattggggattatgcatttatagagaatgtagatattattctggtagatggctggagcaagtttggaaatggcgttgaagtagctgtattgaatgaaacgggtggacgtgaagtgcctattcatgatcgtctgtcagcgcatcaggcctatattttggcattgtatcgtcatcgtcctgaattgatttgtcggatgaaagccattattgaccagtatgctgaagagaatgcttcggatacaggtactattggccagcatgttactattgttgatgcgggatatataaagaatgtacgaataggtgattattgtaagatagaaggggcgggacgattgaaaaacggcagcttgaacagtaatgagcaggcgcctattcatatcggctatggagtggtatgcgatgattttattatatcaagcggttctaatgtggaagatggaactatgttgacccgttgctttatcagccaggcatgtcatttgggacataactattctgcatctgattctttgttttttagtaattgtcaagaagagaacggtgaggcatgtgccatttttgccggaccctttacggtgactcatcataagtctactttgctgattgccggaatgttctcttttatgaatgcgggttccggctctaatcaaagcaaccatatgtataagttaggtccgattcatcagggagctatggagcgtggggcgaagactacttccgattcttatattttatggcccgcacgtgtaggtgcattttctttggttatggggcgtcatgtgaaccatgccgatacttctaatctgcctttttcttatctgatagagcagcaaaataccacttatttggtgccgggggtaaatttgcggagtgtaggtacgattcgagatgctcaaaagtggcctaaacgtgacaaacgtaaagatccgaaccgtttggatcaaattaattataacctgttgagtccttatactattcagaaaatgatgaaagggcgtagtattctgaaggaattacgtaaagtatccggagaaacctcagaaacttactcttaccaaagtgcgaaaattaagaattcttctttaaataatggcattcgtttttatgaaacggctattcataaatttttgggtaattcattaatcaagcgtttggaagaagttcgttttaacagtgatgaggaaatccgtgcccggttgattcctgatacagagatagggacaggagaatgggtggatatttccggattgatcgctcctaaaagtgagatagagaagttgatggcagatatagaatctggaattctgactaatgtggatcagattcatgaccgttttgttgagatgcatcgtaattattatacatacgagtggacatgggcgtacgagaagatgcttgagttttataatctgcgttccgatgaaataacggcaaaggatgttattgctatcgtgaagaagtggcaggaggctgttgtcggattggataaaatggtctatgccgatgcgaaaaaggaattttctttgtctgctatgacggggttcggtgcagatggatcacgtgaagaaatggagcaggattttgaacaagtgcgtggggtatttgaaagtaatccgtttgtgacagcggtgttgcagcatattgaagcgaaaacagcgttaggtaacgagttgatagaacggattgcttctatatgatatttttgatgagagtattcaaactaagatgaacattcggaaaagttacagatggtagttatatataaaagagccgtatgaacgctggagtagttatacggctcttgctattggatgacatttgagcttggacactcccttttttatttttttaccacaggtagtataactctgcttgcagctccttgctgatgataaattttgattttttgtttcatcacaaaatcttctaccgtacaatgataggtatcaataaatttttgtggattgcggtcaataatggggaaccaagagctttgaatttgaatcatcagtctgtgtcccggtaggaatgtgtgtgccacatcatacagtgtgtaattaaccggagttatttcttccggtttgaaaggcaggggattgtcgaatcccttacggaagcgtcctctgaacaattcgccacgaatcatcagctggtacccactcattggatagtcactctttaaataattgcgtgcagttttggaatattcaaatttttcaggatatacatcaattactttcaccataaaatcagcgtcagtactactaatggcagtcattaattccacttctatagggccggccagtgtcaatgtatcacatagcggctccgtcatgaaagtaatgacatcgggacgtgaagtggcaaagcgttggtcatctaccatgaattcttttgtccggtaagtggtagggtttgccgtatagggtaccggacgtgacatatctgaaatatattctgaataagactcttgttctgccggtgcttgtgtggatactgatccgtttttatgtatataataaggtatgccagtagttttttgtacaggccattcgtcgtatgttttccattcgttttcacctgtatggaatatatttactttatgtttgggcttttctccctttccttccaggaaatatcggaaaaaaggatattctatattgtccatgtaataagccgaagtgcttttgccgaaatacagattaccgaaaccttggaacccgcgtactgtccaggctccatgccaccaaggaccgaatgtcagatataaatctgtatccggtgattgctctttgatggctttataaagattccaagctccgtaacagtcttcggagtcatacagtccacctaccaccaatatggcgggcttcaagttataacaggaggtacgtgcgtcgcgctctttccagaaatcatcgaaatcagggtggtttttgatatcattccacaatgtctgtgtagtatcacgtaccaagtcgtccacgttcttaaaggtaccgagtgtcagaaaatctgtgtaaacatcattctttacaatttggttcatcactcctttccctatgtggcgtccttccagtctgggaaggaaattagtggtttgcagcagggtgaaggctccgttgtgatgacggtcatctccacggaaccagtcggtgacgggagcttgcggagaaacagctttcaaagccggatgattggaggaagctgtcatagtggcatagaaaccatcataactgattccccatgttcctacatttccgttattatatgtgttgtgaatcaaccattctatggtatcgtatgtgtccgtagcttcgtctatattctttttatctttcttaccctttttgtttttgttgagagggcgtacttggataaatatcccttcactcttatgccgtccacgtacatcttggaagacgataatatatcggtgctctatatagtttttcagattagtcctgaaatgacggtcaaatccttctccgtatggggaacaagagtaagggctgcggtgcatcaggataggatgctgcctgctgttgtctttcggttcgtagacagcggtgtaaagcttgattccgtcacgcatgggaatcatgacttctcgtttcgtgtagatttccttcagtttgagttcgatactgtccggttggttttttgcttgggtttgtgtccatcctcgagggatgagaaagcataacagtaatgaagtaataaataataatttgcctaattttttcatgtataatgcgatgttattttaatgagttggcaaaggtaaggacattccttgaaagttttcacgctaattaaggaaaaatttcgataatagttactacctttgtcacactaataacttttaactaaaaataagtatcaatatggcaacacctccgttccactatcagcacatgttcccgttgggacctgataaaaccgagtattatttgctgactaaagattatgtgtcagtaagtgagtttgaaggaaaacctatcttgaaaattgaaaaagaaggtctgactgctatggctaacgctgctttccgtgatgtttcttttttgcttcgccgttcacacaatgaacaggttgctaagattctgagtgatcccgaagccagtgataacgataaatatgtagcattgactttcttgcgtaatgcagaagtttcagctaaaggtaaattacctctttgtcaagatacgggtactgctattatccatggtgagaaaggtcagcaggtatggaccggctattgtgatgaagaagccctttccttgggagtttataagacttatacggaagaaaatcttcgttattctcagaatgctcctttgactatgtacgatgaggtgaacaccaaatgcaacctgcctgcacaaattgatttggaagctactgagggtatggaatacaagttcctttgtgtgactaaagggggtggttcggcgaacaaaacctatttatatcaggaaacgaaagctgtattgaatccggctacattggttcctttcctcgttgagaaaatgaagactttgggtacggccgcttgtcccccttatcatattgcatttgtaatcggtggtacatcagcagagaagaacttgctgactgttaagttagcttccactcactattacgacgagctgcctactaccggtaatgaatacgggcgtgctttccgcgatgtggaactggaaaaacaagtattggaagaagcttataagattggtttgggtgcacagttcggcggtaagtatatggctcacgatgtccgcatcatccgcttgccccgtcacggtgcttcttgtcctatcggtctgggtgtttcctgttctgctgaccgtaatataaaatgtaagatcaataaagacggtatctggattgaaaagatggatgataaaccgggtgaactgattccggcagcacttcgtgaagcaggtgaaggagatgtggttaagattgacctgaaccaacctatggcggatattctgaaagaattgaccaaatatccggtagctacccgtctgtcattgaacggaactattattgtaggtcgcgatattgctcatgctaaattgaaagaacgtttggatcgtggcgaagatttgccgcagtatatcaaagatcatcctatctattacgccggtccggcaaaaactccggaaggtatggcttgtggttctatggggcccactacggcaggacgtatggatccgtatgtggatttgttccagtcacatggtggtagcatgataatgttggcaaaaggtaatcgtagccagcaggtaacggatgcttgtaagaagtatggcggtttctatctgggctctattggtggtccggctgctatccttgctcagaataatatcaagagcattgagtgtgtggaatatccggaattgggtatggaagctatttggaaaatagaagtggaagattttccggcattcattttagtggacgataaaggtaatgacttcttcaagcagttgaagccgcgttgccttggaaattgtaaataattaattatttcgtaataatactaatacagccttcctccctttaaaggagagggggctgttctgttttttatttaattggtgttatccgttaccttaataatatgatgaaaaaactacgattgttgtttgtgctgttatgggtgacaagcaacttattttcttctcctgttacaggattattagagcgcatcgacaaaggagcttcctccaaatttattatcgaacgtcagaaatcggggaccgatttttttgaactcgatcagaaaggtgataaagtaattatccggggtaatgattatgtaaatattgctaccggattgaattggtatttgaaatattatgcaggcatacatctttcttggaatggaatgactgcaaaactgcctgctgttttgccccctgtgactaaaaaggaacggcatgaaacggatctgccctatcgttatgatctgaattattgtactttctcttactccatggctttttgggactgggagcgttgggaaaaggagatagattggatggcgcttcatggtatcaatctttccctggcattgacagggactgagtcggtttggagaaatgtacttctaaaactaggatatactaaggatgaaattaatgagtttgtagccggaccgggttttacagcttggtggttgatgaataatctggaagggtggggaggacctaatcctgaaagctggtacatccgccaggagaaacttcagaagaagatcgtaaaaagaatgcgtgaatatggcatcgaacctgtgttgccgggatattgcggcatggttccccataatgcaaaggagaaattaggattgaatgttgctgatcccggattttggtgcagctatcatcgtcctgcctttttacagccggaggatgaacgctttgaagaaatctctgctttgtattataaagaactgacaaaactgtatggaaaaactggtttttacgctattgatccgtttcatgaagggggaagtactcaaggagtaaatttggatgcagccggtaaagccatcatgaaagccatgaaaaaaacaaatccggatgctgtgtgggtggctcaggcatggcaagacaaccctcgtacttcgatgatagaacatttggaagcaggagatttattagtcttggatttgcacagcgaatgccgtccgcaatggggggatccggcatcagaatggtgtcgcaaagggggatatggacaacatgggtgggtgtattgtatgcttttgaattttggtggtaatataggattgcatggtaaaatggacgcgctaattaatggtttttatgatgcgaaaacagataaccatgccggaaagacgttgtgtggagtagggatgactccggaaggtattgagaacaacccggttatgtatgagctggtgatggagttgccatggcgtgagcatcggtttactcgtgatgagtggttgaaaggatatgtatatgctcgttatggggtagaggatgaggctttgcaacaagcttgggatttactaggtaacggtatttataatagtcccaaggagaagatacaacagggaacgcatgagtctgtattctgtgctcgtccggggttggatgtatatcaggtatccagttggtcggagatgaaagaatactataatccgcaggatgtgatagaggctgcccgactgatggtttctgtggctgataaatatcagggtaataataattttgagttcgatttggtggatgtgctacggcaggcattggcagaaaaggggcgtttgatgcaaaaagtggtaacggctgcgttccgggcaggagacaagcaagtatttgagttggcttcacagcattttctgcatcttattctattgcaagaccacttgctgggtacccggaaagaattcaaggttggaacttggattgaagcggcacgttcagcaggacagacccaggaagaaaaagcattatacgaatggaatgcacgtgttcagattactacatggggaaatcgtgtagcggcagatcaaggcggacttcgtgattatgctcataaagaatggaatggcattttgaaagatttttattttatgagatggaaggcttattttgattatttagcttgtgtcctggatggaaagcaaccggaggaacttgatttttataccttggaagaagcatggactaaagaaacaggattctattcctcaattcctgaaggaaatactgtggtagtagctaaaaacatttttgaagaagttttttaaatgttctttctactatggataacttaagactttcataggttataaggcttgattatgggttcagaactgatgggtatgaaattatgataactttattcacggtagggggtgattgaatttaccccttacagtgaatgaaagttatggaagcagatagcgtgtagaaaacgcttacttcttcttttcggatgtctgtttccagatacgtaccatatagaatgcacaatgtgtgaacgcaaagacgaatgaaatagcgagcaatgtcttgtcttcctcccagcctacagtctgttgatgccataatcctgtaataactgaaagtacagacagggcgattcctgccatattcaatatggtgagtcctttgcgtcgttttacattatgctctagcttgctgtgttttactccgtagcaggcataagcatccagacctatcagcatccataataccaatcggatccaagtatcagccggaagaaacaacatcatacaaaggcaggtaaggatgcctagaatcggtaccgtgggaacaaaaggagttttaaaggcacgatgtacgtcaggcatacttttgcgcacgatcaatactgccgcgcaaaccaatgtgaaggcgaataaggtacctatactggtcatttctccggctacacgtgccggaacaaatgctgccagccctcctacaatggccatgaataacaaattactgtgtgccggtgtccggtatttctcgtgaatctttgaaaagaaaggaggcaacagtccgtcgcggctcatacttagaaatacgcggctttgtcctagcaaagttaccataataaccgagcagtaaccaaacaggatagccagtacgatggcccggttcaaccacggataatccggatgaattactcctgtggcatctgcatgtcccatgtggtcaatcgctacggcaacaggtgcgataccttgttgtcctgcaaagtcagaataatgggcaactcccgtcattacgtaagcaaataccatataaagaatggtgcaaatcagcagggaacctagaatgccgacgggcatatcccgcttcggattttttgtttcctgagcggctgtacttacggcgtcaaaaccaagaaaggcgaaaaatacaatcgctgctccacgcaatacgcccgagaatccgaactcgcctaaagtacctgtattggcagggatataaggaacataattctctgcattaatgtatttccatcctaatacaacgaaaataagaatcactgccaccttcaggaatacaatgaagccgttaaaaatagaacttccttctgttccacgaatcagaaaaatactcatcagcactacaatcagtgcggccggtatattcacaatacctccgtcccagggacaagcagcaaatgcatggggtatattgatccccactccttccaaaaaaacaacgagatatctgctccaactgatactgacggtagtagcggcaacagtatattccaatactagatcccagccgataatccatgctataagttcgcccattgtagcatatgagtatgtataagcactacctgctacaggtatcatggaagcaaattcagcatagcataaaccggcaaaacaacaaccgattgccgctatggcaaaagataaagtaatggcaggacctgtgtatcctgcggccactgttccggtgatggaaaataatccggcaccgatgataacacctactcctaatgcgattaagctccatggtcccaagactcttttcagggtcttgtttccagactcataggcttcggcttgtaatgcagcaaaaggtttcttgataaataatcccatatctttttacaacgtacttagtgataattgtgtgcaaaggtacggataactgctatgaattacaagctataagtaaaggctataacgattattcaagatatttcgttattcttccacttagttggagcagggaaatttcacagactttggtgttatattcagcagataaaatacgttcttccgcatcaagcagactcttttgggcttcacgcatctcgataccggagagatctcccagcagataacgttctttggctatttcatggttttcacgggcggcaaccagattttggcgttccaaatttaataaacgtaaattattgcgataggcttgccacagattgcttaaatctgctttcaaacccaattccagttgttctctttccagttgcgagttacgtatttgcaggctggcattgcgcttttcacggcgacggttaccatcccataggttaatgcctacggtaattcctccgtttagtccccaattgcttctccggctggtggcgtttgtttcatatttgttgaatgtatagccataaccggcgttcaatttcacatagggataattacgggatagaacctgacggtaatccaattgggcaattgttgtattttgatcagctttcagcaggttggcattcgtcttaagggtggattcccataattcatcataattcagcgcgtcattcactgttatgatagagtcattgacacgtagcggccggttgacttcctgtacagccattaactcgttcaggttgatacgtgaggtaaccaccagttcttgttgtttcatatattgtgcactgtctgcattgaagtccactttggcttgttgataatccagccgggaaaaattaccgatatggtatcgttcttctacaatgcgcaggcgttctttggataaagacacagcgtaaaggaagttcttcagacggatttcctgttgtacataattatagtattcggcagtgagtcccgctatgaaatcttcaagggtgatacgcgtgttggtttctccctggtgttccaattccttaagttttttgtaggtggtgctgatattgaatccgtcgaacagagtccagtttacatccagcccggcctttaaggtttggtcgtagatgtttcgttcactggctgtagtgcctgtacttctgcttttggtatccgtattgtccaacgttcctgtatatccggcagacaaatcaacagttggcagataaccggcatttgctaatgtggcattgttatggctgatttgttcttcattacgggtgatacgtatggaataattgtttgcaagcccttcctccagacattttttcagcgtataaggatattgcgcataggtggaagccacccatgcggtgcagatacataaagttataatgattcgtttcatacaatttctgttttaacgtttcggttggtagatatataactataaatagccggtacgatatacatggtcaggaaagtagatactaacattcctcccacaacagccgtacccatggcgatacgttgattggcgccttctcctgttgcgaatgccagtggaatcaaacctaatacggtagaggcacttgtcatgagaatagggcgcaagcgttgcaaagcggcatcccggatggcctgcatcttgttttctccgccctcctgcttctgattggcgaattccacaatcaaaataccattctttgccactagacctattaacatgataatgccgatttggctgaatatgttcatcgtgatacctccggcatacatgaaaatcagtgctcctgcaatggctagcggaacggtaagcatgataatgaaaggatccttgaaactttcgaactgtgctgccagaataagatagataagtatcaatgccagaatgaaagcaaacatcaggctggatgaactttcccgatagtctttggagtctcccgacaaggcggtacggaaggtttcgtccaaagtctgggcggcgattttatccatttcttccaaaccttgtccgatggtctttccatctgctagtccggcagatacggtagcggaaataaaacggttgtagtggtataatttaggaggagctacggattctacaaattctaccagattgtccaattgaatcatttcccctttgtcgcttcgtatgtaaatagatttgatattggccggtgtattacgttgttggcggtttatctggcccaaaatctcatattgttttccattcatataaaaatagcccatacgttgtccgctgagaccgtattgcagtgtttcggctatatcacgcacagtggctcccattgtgcctgccttatcacggttaatattcactctcatttctgggctgctgaacttcaggtccacgtccgccatctggaaagtagggttatcatatactttgcttaaaaaatccggtaatactttctccagtttttctatactgacagcttgtagtacatattgtacgggcatacttcctctccgcccgccgaaagaagactgttgttgcacaaaggcacgtgctttcgttttattgcggatggcctgtgaaatacgttcggcaacttccatctgggtataatcacgatctttgatatctttcaatgtgatacgtatatttccactgccactggaaacgcgtgcggttactgattctgcatcgggtataatagaatctaccagattgttgatatcttccgtataatcacggatgtattcatagctggctccttcagctgcacgtgtattgatacttatttgcgaacggtcctccataggagccatttcagcgggtatttggccccaaagtactccgatggctatcaacataatcactgtaacaggtattgcccatatgcgtcttttaagaaaagcattcagtgaacgggcatatatgcggttcataccttcaaagaaaggctctgtcttttggtagaaccatccctgtttttcccgtttaatcaataacttggttgccagcataggggtgaacgttaatgcggcaaaggaagaaatgatgaccgaacctgccacaacgaaactgaactcacggaataaacgtccgctggttccttccataaatacgatgggcaagaacactgccaccagggtgatagtggtggagataacagcgaagaaaatttcttttgccccttctattcctgcttcgaacggacgcatacctcgttctatgcggatatagatattctctgtcataacgatggcgtcatccactaccaaacctacagacaataccaccgccagcatggtcagcacattgatggagaaacctgctatgtacatcacaaagaaagctccgatcaatgaaaccggaataacgatgcagggaatcagtgtcacgcgccaatcgcgcaagaacaggaaaatgatgatgataaccagtacgaacgcttcatacaccgtactttttacttcatcaatagaagcgcggataaacttagtgttatcaaagccatagctgtatttcacatcgtcgggcaaatcctttttcatctgctccatacgttggtatacggcatcggcgatttcgatatggttggcaccgggttgtggaatgacaacgacacctaccatcggcactccgttcattttcatataactcttgatatctgccggacctagttcggcgtaaccgatatcgctgaaacggacaactcttccgcctacttcttttaatatgatgttattgaattctttagcggtgtgcatttgtcccatggtgcgtaaggtcaattctacggtattaccttcaatgctgcccgaagggagttctatattttcattggttatcgcgttctttacatctaccggagtaatgccataccctgccatcttggtggggtcgagccataagcgcatggagtaacgtttttctccccaaatagatacgctgcttacatccgaaatggtttgcagttgttcttttacggtcaagtctgctatttcactcagttccaacagagagcggctgtcactttggatagctaccatcaggataggcgttgcatcggcatcagccttggatacagtaggagggtcacagtcgcgtggcaggtaacgttgtgcgcgggacactttgtcacgtacgtcattggcggcagtttccaaatcgacggataattcaaattccactgtgatacggcattgtccttgttggctgacactggacaaagaacggattcccggaataccgttgatgttttgttccaaaggctcggttatctgattctcgattacatcggcattggcacccgagtaactacagctaacagagatgatcggattatctaccgaaggatattcgcggactcccaatgtattgtaaccgatcagtccgaaaagtaatatgatgatggtaagcacggtggcaagcacaggcctacggatactaagttcggaaatattcataaaagtatttttttagttgttagttaatggcctgaagttccacaggcattcccttacgtaattgcagtgtacccgatgtcaggatggtatcacccacagacaatcctcgtacaatctgtacttcggcttcggtacggagtcctataataatatctacagggtctgcaactccgctacgataaacaaatactttatttttacccatttcggggacaatagcttcggatggaatcgctatcgcgtcttctatttctttttgttttaattgaatatctgcatatctgcctgccagcagttcgccgttgcggttggggtagatggcacggatgttcaatgaatgggtttccatatctatactggattcggttgcataaacctgtgcatgataggtatccagttttccttctactttgaactccagattagtccctttttttatttcccgggcataacgttccggtacagcgaactctactttcaatggggtcactttggtcagtttggctactacagtggtaggggaggcgtatgctcctgtactgacctgtctcaatccgatgataccgtcgaatggtgcgcggagttcggtcatgtcaatattggccttgatattttcgatatcggcgttaagggtggcaagttcggtttttacctgttcgtatgcttctttactgactgcatctcgttttaacagagcgttttgacggaacacacggtcttcggctaaaggtatttgtgcttccagacgttttaattgagcctgtaactgccggtcgtttactttggcaagtaattctcctcgttttaccaatgtgccttctgtgaaaaaaatatcggtgatctttccggaggtttcaaaagacaaactcacttcttcgtcaggaaccaggcgtccggtaaccaatatttcatctgtcagcaagtgtggttttatgacttgtgcattgactttcaatgtacgttgcttgttttctttaggtaacgcgtcggcggctgtcagttcttcattttcgtgaggggtaaattgatagatgcctagtccggccaagccggctccgattaatataatgatgccccatttgattcgtttgttcatgtgcctttctatatgggtttaataaatacgttaatgtaaggttagataaaaaaacgtggcgctcagtttaaacgccacgttcttttttaatattttttttcgtttgccagcttccacatcgcaaggaaagaggctttggttatatcgactatcttcagccaattaattttctgtgtttcatctcccggaaggtgataatcgggatgggcatcagtgtgataccatataataggtattcccagtttggcgaacgtgccgttgtcgctgcctcccaccggattgtcccaagcccggtagtcaggagatagctgcaagcggtaatcttcaatatcttttttcagccagtcaccgaaggcctgatgggctgcggtatagaagtaaacgaaataatcgggctggtcctcccggttgttacgtcctatcatgtcatagttcaaatagccttttaccttcttaatatccggatagttcatggcgaaataacgggatcccagcaatcccttttcctcaccatcccaaaaggcgaagataacggtacgttccggttgctcaccggtagcaagaaaggcacgggctacctgtaatacggcttgaacgcctgatgcattatcatctgcaccgttataaatctgatctccttccagcataggatcgtagcctatgtggtcgtaatgtgcgccgataatgacaatttcatttggattctttccttctattttacctaagatattacgtaatgccaatttttgatgtaccacttttttcagttccgcaatagaatcgggatgtacttgccagcgttttcctttcacttgccgttcagcatgatatacatcaaagggttgtatataatctccggctagcagtggttttattcccatctgtttcaggcaggaaatgatataattgcctgcaatgcgtccacctttccatccggcttcgcgtccttccagttcgtcacaggccagaaagccgatatgtgcttcggctgtggcacggttgatagtttctactccttttttttcaggagtcacttttttaggagaagcggcattcagcccggtggtgcataatgcaaacagtgcaatagctaagaggtgttttttcataaagttgtggtttttagtaagcggcgcgatacttgccttcttccttgtcttccaacatgttcaggtaagaagtatagcgtgactcgctgattagatgtttctccactgcatcgcgtacggcgcatccgggctcgtgcctgtgggtgcagtttccatacttgcattgagcggaatattcaaatatttctttaaagtaatgtcctacttcctcttcttccatatcaaatgttccgaaacctttgatacccggagtgtcgatgatgtatccaccaccgtctactgggaacatttcggaaaaggttgtggtatgcattcctttgttatggtaatcggaaatttcacctgttttcaaggtttgttcaggcaaaatagcattgattaatgttgatttccctactcctgagttacctgaaagcaaagtgacctttcctttcaggtcttttttcacttcgtctgtacctatgttgttcagtgcggaaactttgaagcaagggtaaccgatgtatgtgtacaggtttatcagagcatccatatagcgtgtatcatcctcattatacctgtctatcttattgaatatcagtttgacgggtacacggtatgcttctgcagtggctagaaaacggtcaatgaatatagttgaggtttcgggataattaattgtaacaatcagcatacattgatccagattggccgccagtatgtgcgattgtttggaaaggttagaggcgcgccggatgatatagttcttgcggtcttctatctcattgatgaaggcggttccttcattgttgataatgatttgtacataatctcctacagcaatgggattggtactccgaataccttttaaacggaaatttcctttgatcttgcattcgatggtacgtccgtcttctgttttgacaagataccagctgcctgtgttttttattactagtcctttcataaattaaaatgaaggatgaaaaatgaagaaagagggattggaccgcacggacaagagcaaggctgtgcaggacaattcttccttcttcattattattgcttcattattttaagttcttcattaaaccgtcataatttctttatctttctctgccagaagttcttcaatcttcgcgatatatttatcgtgtactttctgaagtttggcttccgcattcttttgctcgtcttcgggcataccctctttaacagcttttttcagtgtatctatagcgtcacggcgtgcgttgcgtatacttacttttgcggtttcgccttcgcctttacattgtttggccagttgcttgcggcgttcctctgtcaatggcggaatacccaaacggatgatttcaccgttgttttcgggagtgatgcccagatcagagtccatgatagctttttcgatgatacggaacatacttttgtcccatggcttgatggcgatactgcgtgcatcgggagtagtcacggcagctacattactgatgggaaccatgcttccataagagtcaacacgaatgccgtccagcaaccgggtactggcttttcctgcacgaatgtgcgctaaggcctcttccaaatacataacggccatgtccattttctcttgtgcgtcgttgatgcaagtttttgcgtctatcatactgttctgttatttaagttgtttattgattcgttttaagtgaaacaaaagtaatttattttttgattatctgcaataaaagggggatgattttatatttctaacggctctttactttatcatcaccagtttaagttgttgaggctttattaaaaataggtgaaaagtttttgtgtcctatcggataacaggattgaaatgatgaacaccttaagcttttcttccctgtatactaagtcctttttattgcatgattaagctttttcatacggcaacctattacagactccgataatggactgtataaactattgtagtggactgtagggtctgctgtaatagactgtacggtccactgacggagtctgtagtaggttgccgtatgaaaggtcttagctgtgcggaagaaagcccttagtctacggggagaatacttttgtaatcaggtataacaacgagacagacaaagacatcaacagaattagggtaaatttggttggtaagcattatctttgcattaaaaaagatgataactttatatttagcccgtcacgggcagacagaagagaatatgacccgtattttccaaggacatatgccgggcacgctgactgttgaaggaatagcacaggctgaagcgctgcgtgatactttgcgggacatctctttggacgcagtggtcagtagtgatttgaagcggtgtgtggatacggcccgtatcgcagtggaaggtcggaacctgccttgggagaaaatggttttgttgcgtgaaatcgattgggggagctggacggggcttgccattaaagaagttgatttgcgacattttccggcagatgtggaaacggaggcgatgctgtatgagcgtgcggggcgttttgtggactacttgaaagagcgatatgatggaaaacaggtgttggctgtcggacatggactgataaacagggcggtacaggcacacattcaaggagtaactttggaacatttgcgtagtgtgccaaagatgaataatgcggaactacgccggttcaagttaacgtaattccgcattgaataacacgtggttattgcaaagtgattcccattattcctatcactacatcattggacagggtttccagggtcagcccttttagttccttggaatgatccaaaggaatatcgagcaatatgcctgcaccaccttctatctcacgtccatatacaccagtgatgttgagttctttacccaggtcacggcttactttaccgcttttcaagtgcagacggtacggccggggagcaggtacttggaacgctttgccgtccacatagaggtcttgttctatgggacaccagttgtccggattgatcaactccgttgcttgggaagttccgtctgcatagtgtatgcggattattccattggcaatgtggcattgcatgtggttggtacttcccgccatcagcagataagcatgtgaggctgtaccggatagtgagatggtggaactgtccgggtaattatcccatagggaggtgaaaagaatgttgttccctttttctttcagacggaaagggatgcctaaagacgtttggaaagtatcatgatgtacaaggctgcgtaatcccgagtcgtttatggtggcgctcagcagcggatgacaccattctcctattccctgtgtgggaagttgcaaagtagtgtatggagaccggggagacaggtattcattttgataaatatcggtgacagaagcattcagttgtctgtcaaaatcaatcatccggcatttttcgggacggatatctgcaaagtctgtataggaaggggctttccgggtgttctctatatagatattaacaggttgccaccaatccatttctccttgatgagtgtaaacaaagaaagtgtggtgtcccggttcaccttttagctgtgcgttgaaagcggtggcttccactgtgtgttttgctaaaacgctctgaggatcatatacttgggagatggatgctcccgaaggtatttgcaaagccaacttcccgtttgaagcgatgactagttcttggactgccaacgtatgaagtgatgctccttcccattcgatggtaatggtggttgaagatgttccttccgcctggattgaaagaagaggatagccatgggccgattcgatggattgccatgtggcaggaacaccattcacttttactgaacggatcttctcttttctggcattgatttgcaataccggatggagaggagtctggaaccgttgtgtgatatgataggtgtccgtatcttcttttcgggtaaagcgatagcttatatcgggagtactgacggaagccttgtcccagtcgtccggaaagcccggccggaggatgatttgctggttcagggcatccggcaggataccgaacagtccttggatcagtactcgtgaagcgaccccgatgggatcgccgaaatcccggtagcattctccgcgtgcggcatcatagaagctgatctggccgaagttgcccggactgtctcctagatacatgccgtctagaacagagcttttcaaaagtttgtatccggcctcggcacgtccggcctggaagtatgacaatgcggtatgcatgacttcggcaaaggcgatattattgacactccatgagtagggtagccagttggtggtggcgatagtggcatatccattctcttttaatccatgggctgtgacgggaatatgaggaatggctgtgtctatataacgggtagcctgataggcttggaacgggttagctgtctcgctgtctatagcatgataaatggtccatacagcggcactttcgtgtactcgcttgtgtcccataaaatcttgatattccgcccaatgtcctttaccgggaagccatagcctctcgttcatggctttcagaatcttttcggcttcgttgcggtaaggagtgggatcttcgcctatcttttcagccaattgggccgctgtcttgttggcacggtagttataagccgatgaatgggtgactcctccgctattgtaataaagggcgtcactggcccaaatgcaggcgtatgcgtcatacagcccgtcgttatctgggtcgtagttcagcttttcccatgcgaggtgacgggtgatgacaggccacatttggcggacataatccaagtcccccgtccatttgaaatgccataacaattcgtctatgtaacaaaggttcatgtcgtagtggtgcatctgattattgcgatgcggattacggcagatgtatccgttactgtattggggggtaccccatttcttgacggaacgtgccagatgcagggcggaatcttgtgccggatgggggagggtgttgggcacttcggtgacctgacttgccgcgtatgcgttgaaatgggtccgggcacggtcatgccatcccaaaacatcgccggtataagcggctcgccaaccactgagtggcatccgccatcctatggcaccgtgtaaccatacttcgccgtcccagattccatcagctgccatggccagagtgcctcctaaggtgttgaaataagggtcgggtgtttcaatgcggatgcgtgaggctgtttcggagcgggcagcttctgcttttttaaacagggtttcgccttcggcagttgtcagtgtacgtagttcctggttttccaatagaatataaagtgttccatctatctgtgccgggcaggattgtaactgttgaggctggagaggagcttcgaaactgtcggcagggtcggctcccatatctccgttacggtttagcttggaattacgtatctctgaaatggatgtcagtagaatgggattggatcccttgaaattccgggcgttgaattgccagatggccccttctttatcgggaagtgccaatgtggcaatagataagtttccaccttcgaaggatgggtggaataaattgtagctgcggcgtcccgctgtataacgggactcgcagtgttcggtagaatcaagggctaccgttcctccggaggtctgcagtttaaagcagatgtgtttcgggttcttcttggtataagcagcgaatacgggccggtcgcttgtctccagccggaatgctgtgtggctgccgtataaggcacgggtaaagcgattcttaccgttgatgcagacaaaatcgtctccgtcaggggtatattgcaggcttcgggtggcattccggcgatgctcgttgtacgaagtggattctatgaaatcgcctatcttttgtggctgcttggtttgtcctgcgccggaaacgctaccgatgcccaacaggcatagaagtaaatatgtcgttttcatgatgataactactaactcctgttcttacggtaatggctgtaatccttcccagcgtacattccatttgccatctttcggaaatccgggattgttcccttccgatccatcccatccggcgcacatcatagcgactgtggtcagtaatccaccgttgccgggcaggtaaatacgcagacgcccgtcctggtaattgtgaccgtttaccagataggtgttggtacgtttgtccatcaataatgcgctgactgccttctcaggctcacccattcgggcggcattcatggctgtcatcggataatcccagccccaggtcttgtcccagttccagttatcccaaatccagtgcagggtgtttttcatatatccggcatgaatcagctgattcatgggcaggatgccgacagcgcccagcactgccatgtgatctgaggtaaaacggatatctttataggtatccaccgcggtctcggctgccagatacagctgttcgtcgttgtatgccagcggagataatttctctatcagtacatcccattcgggtacacgttccatccctgtacgttcacgccatgtttgggcaacttgcatggcgaaatgccagtacgaaagctcaaaaggcggattgacagtttcggcagcgcgcaacgtttcctgtgcggggatagcacctttcaagacataacggtcgtgctcttcctcgtatgtggcgaatgaatacatgaattcggcggtttcctgtatcaggttattgtatttttttagcagttcttccgatggattagcccgatagagcaattctgccaggtagatgagatgaggctgttgccagatcaggaagctgcctactttagagggggcttcaagaccgctgggatcagtcattttcatccatcgtatgcctttgaaaccttgtctttccgctatctggcgggctatgggttccacggtttcataccaggataaagtgcggtccaacaattcgggatgtccccataaggcgaattgtgcctgatgccaccagatcatttccaaatggaatttcccgaaccaggagttgtaagttagtccggtttcctgtggcggggttgagcctgcgcattggatagcgagcagatattggcttaatacgacccggcgttccaattctttggcccggacatcagtacattgtgagaagtcggcaacagctccctgtgtccagtaatttttccagtgtccggaagagacttgttgtacttctgtaaaagtcagaatgggagaagcagatacttgtggtgtgaattggcaggtgaatgtaaatatactgtccgttggcgtgagtacgaaatagtttgcacttttctcacttagcttcgcagggccttcccaactgattgttacataataggtggttgcgtcgagtgttctttttaacacggccgattgtgcgtcttcactgatcagggtcgtgctatgcttatcattcgcctcccaattacaagcatcgtcacagtgaccgcccgtgggataggggaagtgaaacttgatgctggcaggttgtcgggccgataggcgtgcggcaatcatatcacgctccggatggcagactgtctgaatgtagtagggagtttctttgagagtgaaccggctgttgataataccgttccacatatccagtgattgctgtatgttttgcacatccgagggacgtacttcatttcctaattcgagtccgatgatacccagatgcaggcggtgtgggtttacacgataccagtcggatgcttcctttgctctgccgggttctttgggttgggtggcatatagctctttgtgcccgtggccgaagtcatactccaccaaggcttcctccggtttatagttttcgggatttccgaagctgtgccatccccattggctttgtgtacccagtggaactccgtttttatagacttcgggaaaagtctgcaatcctgtagcatctaccgtataggcaaattctccgttccctaccgacagggaggataatgaatccatggcagtcacttccggattattgcgtgttaccagtgcatggcggtctatggctttctctttgggaggggtgcaagcagccaatgcaaacattgtcagagcataaatggtgtgtttcattgtatatagctaatttaaaaagatggataattctgttgtttatgcgatatgattctatttgccaagctgcaggcaacccatgatgaaaggaccggtagctttggcatcgttgtcacgcattttttcgccaatgtaatattcaaagcttccgtcgcggtaaggagtgccgcctagtccgcctacttggcagcaacgggtcagcgtcagagttccgtcggggttctcgagaagcaatgtttgctttaatccgttgaaggctttttccgcgatggtccggtattgggcatctatatatcctttgttcaccgctttggcataagcatacatacattgggtggttacggatgcttcgggaaaattaccttcacgctcgggctggtctattacctgataccatagaccgtctctttgatagttgggcaggctttctgccaaaccttgaatccaactgataagcgaggcacgtccggggtggttgtcgggaatatagtccagtacatctaccatggccatgaaccaccagcctatactgcgtccccaaaaattaggtgaagtaccgtcttgcggatttgcccaacgttgggatttgctctcgtcccaggcatgatgatataatccggtttccggtgaataggtatgtttgtggcaaagtgtgaattgttttaccgcctcatcaatcagatcaggacggttgaattccgctccatagcgggctaggaaaggggaagccatataaagtccgtccagccacatctgatgttgatagatcaatttatgccagaagccaccttccagcgtacgtggttgtcttttgagttgttctaccagtaagtccatagctgctttgtatttttctttgcctgtttctttatagaggtcaaacagaacttttcctgaattgatgtaatctaggttgtaagttgacatatcatagaggtggatttctcctttttcgttaatcaaactatccgcccattcctcaacataagtaaagtaacgtttgtcaccggtatttttccacatatccagcatggcgcaacagcctactccttgtgaatacccgaaaaagagccgtttgccatgatctagctgataggctttgggaaagcggagcatctcagagtcggcaaagcgctgggcatatgaatcggaagatataccgggaaggggtgtggggactgtagggagaggggctatgcatacttctccactgtacggaattgcttttttagcttggagagacatgggtgccatgcaggcggccaataaatagatgtaacagtaatttttcatggtatttcctgtcgtttttatagtctttgaatgatttacattttttgctgatgtaaaaataggctaattaacgctataagtccatgaataattgttcatttagatggaaaatctatcggttgagtctcttttttaaggaatatgtgtcaataaagaacgaatttgtggaaaaaatggtaagacagagaaaaactgttcacccatttgtcatttagaaggaaataaggaatgacaaatggatgaacttgatgagaatatcagttgtgtaccagtgttcctatattttcaccggtcattacttttttcaggttacctactgtgtccatgtcgaaaacgataatgggtaggttgttttccttgcacatgcaggttgctgtaagatccattactttcaaaccgcgctttaatacctcatcgtaggtgatatcgtcaaatttcgtagcagtggggtccttttcaggatcagctgtataaatgccgtccacgcgtgttcctttcagcatcacatcggcttctatctcgataccacgtagggaagacccggtatcggtagtaaaaaacggattgcctgttccggcagacataattacaacttctccgttttccatcgcttcaatcgctttccatttgttgtaaaactcaccgatgggttccatgcggatagctgtcaatacacgtgccttgactccggctgctcccaatgcggaactcaatcccaagctgttgataacggttgccaacattcccatttggtcaccttttacacggtcaaaacctttagaagctccactcagcccacggaagatatttccaccaccgattacaatacctatttgtacgccaaggtcgtgtatctccttgatttgttgcgcatattcacccagacgcttttcgtctataccatattgcttttcgcccatcaggctttcgccgctcagctttagtagaattcttttaaatcttgccatattggtttgttttttagttttttgcaaagataaaaatattaatcttttttacttgttttatatcctaaaatatttcttcccataactccttgcattactccgcgaagtagaagataggtaatgaatgccatccataaagcgtgattgcccattgctccccggaaaccgtagtaaataagaaagaaactgacagaagctgctatcatggctttcagcatcagatgggtggctgtcgcaccgatgaatattccatcgaacaaaaaagcagagaagcctgccaaaggaatggcaagtacccaataaaaataactttcggaagcatgaatgacagttgtttcgttagtcagtaatccgagaaaggattgtcctcctatactatataataaggtgaaactaagtgataatcctagtccccagccgaatagttggcgaaccgtcgtgtggagtgctttctgattattggctccgatatatcttcctgtcaatgcttctccggcgtatgcgaagccgtccataatgtaggagaataaagtgaataattgcataagtaatgtattgaccgccaacaccacttctccttgtgccgcacctgccgaggtgaaaaagacagtaaccgccactaggcagatggtacggaaaaagatatccctgtttacttggaagaaacggtacatggcctgtttgtcaaagaaggaatgccattctatgcgtttccgcagggtgctgtagtagcgtaaccacaacaaatatgccatgactagcccggcatattgtgcagttaacgttccgatagcgacaccttctattttcattcctaatccatatactagaagaagactgaccgcaatgttcactatattttgtgtgatggctatatacatggggaaacgggaattttgcataccgatataccagccggcaaaactgtaaagccctaatacagccggtgctccccaaatacagatacggaaatagagaccggccagatgttctacttcttcagtcgtttggataaaggtgaatgcaattctttctataggatattgcaaggctagcaaagtaaatgcaatgaataatcctactccgacggaacggagtagtaaccgggtgacttcattcaggtcgtgcctgccgtatgcttgtgaagtcatgccgctggttcccatacgcagaaaaccgaaaatccagtagatgatgttgaaaagcattccgcctacagctattgctccgatgtaggcggcagagcccaaatgacctacaatagtaacatcaatcaaacccaacagaggaactgtaatgtttgaaacgatagaagggatggcaatttgaagtatttttttgtttccgttattaagttgaatcatgagtgtagattgatagagatggatacaaaggtactctctttctcataaataaccaatgaaaatttaaatttgaactgaaatttgttgttgtttaagatgatatatcattggattatagatatatttgcggttattaaaatggtcaaaacaggagaattatgaaagagaattttcaaatccatatttggttgggcttattgttatgtctgttaggtatgtcatgttcggatgatactccggctaaaggaaatgaaccgggaaatggcaacacggagttggaagtcaatgagtggatagagagtgtcatgcgcagtgattatttgtggaataacgacattcctgctcaagataaattggatttctctgctgatccccaaacattttttagctctatgctcagtttgaaagatggaaagacgagaaacggaaagcatctttattattattcttatatggagaagaataaagattataaagcacgtaccagcattgatgcggatgatacttatggtatggagtttactttatttaatgttgtaaacgatagtaatcaacctttaggatattattatgcccgtatcctgtatgttcttcctaatagtccggcatcaagtgcaggtttggaaagaggggattggatcgtgggtattaaagggaaaaataatattaattccgataattatggaatcttattaaatggggataggactcaatggctcgtcaaacgtggcgatacagaggtcagaactattgatatagaagcttcccgggccgtggaggacaatcccttattctatcacaatgtatatactcggggagataaaaagatagggtatttggtttataatcattttactcccggaccgaatgggtattcggatcgtacctatgatgaggaaatgaagaagatatttgccggatttcaggcacaaggtgtgaacgaatttgtgttggacttgcgatataatggaggtggatatgagaattctgctaatatgcttgcaggactcctcataccagaagcttctcgaaaaaaagtatttgctgttttctctgacaataaaggacaatcctattctaatgatttttgtgtggagacgaaaggaacggcaggttacttgaaacttaattccaatcgaatttatatattgacaagccaaagtacggcttcttcttcggaagtcgttattaacagcctcaacccatttatggatgttatccttattggcgaattgacagaaggaaaaaatgtaggaatggagatgcagaaaaatgataaatatgaatggatgtattggcctattacattgagagtgactaatgcggtgaattatgactacagtgccggttttaaaccggatatagaatggaacgagtatgatttgactcaaaatccgacggacgttttattaccattgggtgatccggatgaattcatgctgggtaaagccatctccttgattacaggagtaaaacgatcagccagaggcatgaatacgttatctaaatcgattatgaagggggaatctgtgtatcaatcgacagaacgtcatgccactggaggaatgttgatggttcctgaagggaaggacaactaaaggatatatttaacttctttgaaggcatattttctaagagaaccgtttttatctttcagaatcaaatgtccgtcgggttccacacggatcagtttggcagtaaactctccttttgcatcacaataggggtgataaccttccttgcgatattgtgctttcaggtagtattcctgaattttggtgatgatatcagtttctctgttttctatccgggaatagaggtttatgatatgttccaatacgctgtttaaaacttccattctgtctgtttccttttgagtaatttgtcttaatgaaacagggttgggggcggatgaatgaaattcttcctggttaatattgattcctattccaacaatgctttgtgaaatttggcttcctgttaaatcattttcaatcaatatgccgactatttttttgtctttccaatagatatcattgggccattttatttgcaggcaatctgcatggacgtaatgggccaatgcggtacgaatggcagaagctaccgccatagataaaatgaactgactggcgggggcgattgtttggggataaaatacagtgctgaatgtcagattcttgccatattctgattcccatgaattcccacgctgcccttttccggcggtttgatattctgccataagcgtggtgaattccttgatttctttttcctgacaaagttctgcaagtcggtcgtttgtagaggttacagtttcttcttttaagattttgcttaaccagttaggggatttcatcatattcttttttaagtttacgggtgaattttttgataacctcttcgtatgagtggtctatcagtaataaaatcagtttgtcgtcaatgtcaccttgtaatgatacttggttccaatatttcttattgaagtgataggctccttcaatgccggaatgatgttctcttaattccaaggcatattcgggattacattttaaagatagccattccgggttgtccaatccgatgcaggcatacattttccccatgactttgaatactaaggtgacattatcaaaaggaaattcttctgttgttcctttctttctgatacagtaatcgcgtattgtttctatgtccatatataatgtatatatttctaccaaatcggaggataaaaggcttcttcaatatgctctatagtgaaaggagccttttcgcccactaaggtgatgatatcaaaacgtacaggtaaatctactgagaacttgcgcaagtatgcatcagttgaagctatgattctgcgaattttcttatctgttactgcatcttccggattaccgaatctagtattcttgcgggtctttacctctataacaattagttcgtttcgatattcggcgacaatatccagttcttttttcccgcaatgccaattccggtggcggatggaatatcctttatctatgagatatgcagcggcctcttcttctccctccttgccaaattcgttgtgttctgccattctgtttctttttgcacaaaaatactcttttttatgctttgtatttacagaagtaaagctaattttgcagagaatatggcaaacaacgtaaaaaagagggtaaaagtaccggcatcaacccctaaacgcaagcagcgtatggtatgtctgatgagtgaagaggaggtacggattgtggattgttatcttaaaaaatataagataaccaataaggcgcgttggttacgcgaaacagtattgacttttatccatcagaagatggaagaggattatcctacgttgtttaatgaacatgatatgagaagataagatggcagatgatacctattatatgaaacaagccttgatggaggctgtaaaagcagctgaacagggagaagttccggtgggggcggtggtagtctgtcgtgaccgcatcattggccgtggccataatctgacagaaacattgaatgatgttacagctcatgccgaaatgcaggctgttactgctgcggctaatacattggggggaaaatacctgaatgaatgtactttgtatgtcacagtggaaccgtgtgtgatgtgtgccggtgctatagcttgggcacagacaggaaaacttgtctttggtgctgaagatccaaagaggggatatcaaaaatatgctcccgatgccttgcacccaaagacgatcgtggtgaaaggaatacttgccgatgaatgtgcccgattgatgaaagatttctttaagaaaaaacgatgattcttatttcacctcttcataatctacatactctccctcatcctcatcaaagattttttttctgtttcccgacgaatgagaacgtctatttgaagaagaggattctgcaaaattctcattctcgtcattcgcttgattctgagtatatgtattttgtttctggtgggtggaagttcgattttgataggggggacgtttgccgatcccgaacaatacacgcaaaatgttacctaatatagtgaagccgataaaaacaatcagcagaaaaataataagtagaaagcctaaaaatccaaacatagtaatttctttttttatatatcacgtacaacaagcgtgccacgtttattgtttacgctctttttttagttaaaagagatagaatgatataccacaggatgatagctgcaaaactgctgattttaaaaaaaatcaacagggggatgcatacaatgaggaaaatatagctgactttgttctgtttccaggcaagactcttgaattttaatgagaacattgggatttctgccaccagcaataatgacataataactaccaaaatgaaaagatatgccgcattaaaagaatcggatataaggaaagaatgtgctcctacagtcaatgatccccaaaataaagcattagccggagtgggcataccaataaaactactgctctgacgtgggtctatattgaacttgcctaaacgcaaagctgaaaatacggaaataaggaatgcggtataaggcatataatcggcaacaggcaatagaaaatcaggatagtgtacctctttaaataaggaaaagacaatggcggaaggagcgaatccaaaagtgatgtcatcggccaacgagtctaattcttttcctaaaggacctgatactttgaacaaacgtgccaacatgccatcaaagaaatcaaatacagcacctagtataataaaagagatggccaaggtatagtcttcattaaatgccatgacactggcaatacaaccggagaatagattacagcaagttactgcgttaggaatgtggcgtgtgatacagtttgccattggtgatttttttattttagtttagcaatgacggtttcgttacctacagtcgcttgtcccatcttgacacagacttcggttcctaagggaagataaacatctacacgcgaaccgaatttaataaaacccatgtgttcatcaatgtagcaatcttctcctacttcggcataggtcacgattcgacgggctattgctcctgctatttggcgcgccatgacggtatgtccttcgggagtttcaataacgaccatagaacgttcattttccgtactggccttaggcagccatgctttcataaatttaccgttatgatggtctacatgtttcactactccgtctacgggataccaattggcatgtacattgacaatgctcataaaaatagaaatcattaaccggcggtcatgaaaatattcatgttcgtctacttcttctataactactatccttccgtctgccggggctactacgattttttcggtgtcgtgctcgaataatcgaatgggacaacggaaaaagttaaccattaacaggtaaacaacgatacttgcggcggcaaatatatagaatggaattttgcactcaattccccaaaacaacagggcattgataccaattaataggatggcactgacaattaaaatgcttgttccttctctatgtagtcttattttctttaatttcttcagtcggttcatgattgtataaaaccaattatcgtgcaaaaataaacttattttgaaaaccctgcaaataaaagttgttagaaatgcctatttcgacttcatttaagataaaaaaagcgaatgttgataacttcttctttatctttttgcaggttttatgaaagcggagtatctttagacaattttttaggagagtaacgattatgcaggattttgtccatttacatgtccatacccagtattccatccttgatggccaggcgtctattccacgtttggtagacaaggctatggctgatggaatgaaaggtatagccgtaacagaccatggtgatatgttcggtatcaaggaattcttcaattatgtgaataagaagaatagcagtactaacggtgagataaaggatttgaagaaaagaatagccggactggaaaaaggtacggtggaatgtgataatcccgaggcggaacttgtggcgtgcaaggagaagttggaggcggcaaagaggaaattgtttaaaccgattttcggttgtgagatgtatgtggcacgccgtcgtttatttaacaaagaaggaaaacccgatcaaagtggttatcacttggtagtgcttgctaaaaatgaaaaaggataccacaacctcataaaattagtgtcaaaggcatggacggaagggttttatatgcgtccgcgtactgatcgtgtggaattggaaaaataccatgaagggctgattgtttgtacagcgtgtattgccggagaagtgcctagaaatataatagctggaaaatatgaagaggcagaggaggctatccaatggtataaacgtgtattcggagatgatttctatttggaattgcaacgtcataaagcgacggttcctcgtgcgaatcatgaagcttataaattgcagcaaattgctaacgaaaagttgatagagtattctagaaaattcaatgtcaagctggtttgtactaatgacgttcactttgtagatgaagagaatgctgaagcacacgacaggctgatctgtctgagtacgggtaaggatttggatgatcctaaccgtatgctctattcaaagcaagagtggatgaagacacgtgccgagatgaatgaagttttcgctgatctccccgaggctctttcaaatacggtggatatttgtgatcaggtggaattttatagtatagatcatgcaccgattatgcctacttttgctattcctgaagattttgggacagaagaggggtatcggaagaaatatacagaaaaggacttgtttgatgagttcactcaagatgaaaacggtaacgtggtaatgagtgaggaggccgccaaagccaaaatagagaaactgggtggttatgacaaactctatcgtattaaactggaagctgattatctgaagaaattagcgttggaaggtgcgcacaagcgttatggagaagtcttgaatgaggaagtgcaggaacggatcaaattcgaacttcatattatgaagacgatgggttttccgggttacttcttgattgtgcaggattttattcgtgccgcgcgtgaagaattggacgtgtctgtagggccgggacgtggatcggcggcaggttctgccgtagcatattgtttgggtatcactaaaatagaccctattgcatacgatttgctgttcgaacgtttcctgaatcccgaccgtatttctttgcctgatattgatgtggattttgatgatgatggtcgtggacgagtactgaattgggtaactgaaaaatatggtcaggaaaaggtggcgcatatcattacatatggtacgatggcaaccaagctagcgatcaaggatgtagcccgtgtacagaaattacctttatcggagtctgaccgtttgtgtaagctggttccggataagattcctgataaaaaaatgaatttgactaatgccatagcttatgttcctgaactacaggcagcggaagtctcacctgatcctattttgcgtgatacgataaagtatgcaaagatgttggaggggaatgtccgtaatacaggtgtgcatgcgtgcggtactattatatgtcgagatgatataacggactgggtgcctgtaagtacggcagatgataaggaaaccggtgaaaaaatgctggtgactcagtatgaaggttcagttattgaagatactggattgatcaagatggactttttgggtctgaagactctttctattatcaaagaggcgattgaaaatattaagcatagtaaggggattatcttggacattgacgaggttgacatttcggatcctcctacttatgctctttatagtgaaggacggacgattggtacattccagttcgaatctgccggtatgcagaaatatttgcgggaattggaacctagtacttttgaggatttgattgcgatgaatgctctttatcgtccggggcctatggattatattccggactttatcgaccgtaagcatggccgtaagcctattgagtatgatattcctattatggagaaatatttgaaagatacatatggtattacggtatatcaggagcaggtcatgcttttatcacgtttgttggcggatttcactcgtggcgaatccgatgccttgcgtaaagcaatgggtaaaaaactaagagataaactagaccatatgaagcctaagtttattgaaggcggacgaaagaacggtcatgatcccaaagtacttgagaagatttggacggactgggaaaagtttgcttcttatgcattcaataaatctcatgctacttgttattcatgggtggcttatcagactgcttttctgaaagcaaactatcccgcggaatatatggcagctacgatgagccggaatatttcgaatatcacggaaattactaaattgatggatgagagtaaggcgactggcatcatgaccaagggacccgatgtgaatgaaagttatctgaagttttctgtgaaccgtaaaggggatatccgttttgggctgggagccattaagggagtgggggaaagtgctgtgcagtctatccttgaagaacgtgagagaaatggagaatataaagatattttcgattttgtacagcgtgtaaatctttcggcttgtaatcgtaagaatatagaaaacttggctttggcaggtgcttttgatagtttcacgggaataaagcgtgaagacttctttgtaaagaacgctaaggatgaaacctttaccgaagttttggtacgttatggaaataagtatcagatggataaagccgcagctgcaaattctttgtttggaggtgagaatcaagtggatattgctactcccgaaatcattccgtctcctgcatggggggatttggaacgtttgaataaagaacgtgatttggtaggtatctatctttctgcccatccgttggatgagtatgctgttatattagagaatgtatgtaatgtccacatggcggaacttgccgatttaacccctttgcagaacagagacttaaccatgggggggattgtgagtgcagtgcgtgagggatataccaagacgggaaaaccatacggtattgctaaagtggaagattattcgggctcagcggaatttgctttcttcggtaatgaatgggtagagaagaagaacttttttatgactggtatgtttttatttatgcgagggaaatgtcagccaaaacaatggcggcaggaagaatgggaggtgaagataagtactattgaattattaccagaagtaaaggaaaagattattgagaaacttacagtttcagctcctttgtctgcattggatgaagagctgataacggagttttcagccttaatcaaggcaaatcccggtaatgcagagctttattttcatgtaatggatgaggatggacaaatgtatgtcaatctgatgtcacgtactatgaagatttcggttcaaaaagagatcatgacttatttaaagagccaaccacagctctcttacaaaattaattagtatatttgcgctaacattttaaataactaagtataataattatggcactagaaattaaagatagcaattttgaagaattgctggcatcgggcaagcctgtagtagtggacttttgggcaacatggtgtggtccttgtaaaaaaatagctccggatgttgaagctttggcagaagaatataaggatcaggtaataattggaaagtgcgacgtggatgataacgacgaactgaccggtaaatttggtgtacgtaacattcctaccgttctttttatcaaggatggtgaagtgaaagataagactgtaggtgcagtgaccaaggcccagctggaagaaaaaattaaagctttactgtaataaaaagaatattcaccctttaatatatacgactatgggaatggaagacgatttcttattggaagatgaggatgatcaaaaaacgatagagtttatcaaaaattatctgcctcaggatttgaaagataaattcacggaggatgatttgtattatatccttgatgtgattgtggattactatacctccagcggatgccttgatgtacaacctgatgaagagggatacattaatattgatcaagatgaaattgtgaattacatagtcaaggaagccaagaaagacggaatggggccttatgaccccaatgatgtattctttgtagtccagggggaaatggaatatgggaattcattgggacaggtagattaagaagatagtctcataataaaataaaagatgcgtatctccagctagggatacgcattttttatatttgaaaacaaggtaatatctactattagctctcttatttcttttgtaaaagaaaataatagaatacctttgtaaaaacgctcatgctcattttaactataaaaacattgcttaatggctaaaaagaaaaattcccaattcctacctggttttttggaggatatcatgtctttattgactccggaagaacaagaaattgcatttgaattgtttaatgatggagccaatcaggtagatgaagaactgtctcatatttattatcatcatcagtgtcccgattatagattgattgcacagccagtcgcatcttatttgatgcctttgtggacgatggatgatatgagtagtctgtcaccggctgaaatctactcttcttgtgctgttattccacaagaaacattggaacgagatctccgtaattttatttttaacatctttgtcgtatatcggaaaatgcccgaaaaatgttattcatatagaatgtggtatgcattaggaatgatggagcattttcgtatggaacgttgtttggatattgttttggaagtattgcggcaagacttggatttctatgatttttatttcggttatttgtatgaaacaatgttgtctgctataacctatcaattgggacagaatcaattagatgttttgatggactttatgaaagagcctggattgcttcctatgtctaaatatagagtgattgaagcggttgctcatattgtgataactcatcctgccagaagagaggaagtgatggattggtttggtaatttgttgggttattattttgatatactgaaagatcagaagaatgatatttgttccactttgctgcttgatcatgttacagcttgcatgatggatattcgaggggtagaaactttacctattttgcaaaagatttatcggacttatcatattaaaccttatggcattccaagtattaatgaactaaagaaaaaaatgccttatgcggaaatgcatgggttggaaatggagcgggtagaagattatttagctgaagtttttgaggctgctactgatgaggacgaggatgaggaaatttacgatgatccgctttacatagaagatcagcctgctaaaaaacttagaataaaaatagagttgaaagattctgaaccgttagtttggcgcatattggaggtcccttcgaatatttgcttggaaagattttctgaggtggtagaagtggcaatgggatgggatggttatcatttgcatcgttttattaagggggacacttattatcttcctcccaaagatcggacaggtgattgtttttttgaaggtgcactcaaacagtttgattccggtatgctttctttaggtgaattattaagtcgcaagggatcaaagattaagtatgaatatgatttcggggatagttggatacatgaaattatattagaatcctgtcagtcttataagaaagaggaaattccggttattgccttgttggatggtgaaaatgcttgtccgccggaagattgtaatggcatatgggggtatagggaaatgctgaaagctttagaaaaacctcgctccaaagctgcgcgtgaatataaagaatggttggggtataattttgatcctacagaatttgatcttgatgaaactagagggctgttggctgaaattatagattgatttggaatttggttataacagggcgggtgaaaatcccgctctttcctgaaaaaagtgttttatgtctggtggatagggaaatttaatattcacagattttgtttactatgtgtttatacgatgccttgtacattcaaaaagaaatagattcctgtagctatcattaatagtcctaatatagcatagaaaagtcgtgcacgctggcgccctgcattactgacaatgaactgtgtgttgtgtgcggtaaagaaccactcccaattaaataaggctgccagaacggacagtagtcctaccaatacgaatatggcttggatcagataatgcattcccataatttaatgaatttggctgtaggggcagattatgttcgtccctacagtggatattttcttttattcagcttcaaagcgcatgatgcggcttccatcttcagattcttcaatctcgacttttacagcattgccaggcaagagttcttctaccagttccggccattcgatgaagcagagggcaccgctatagaaataatcctcatatcccatgtcgtatacttcgtccagtttcttgatacgatagaaatcaaaatggtaaataagttcgcctgtttcatccgaacggtattcattgacaatggcaaaagttggtgagttaatgacatctgttacccccagctcttcgcatacagctttgataaatgttgttttaccggcccccatctttccgtagaaagcaaaaacggtattgtcacccatggctgcgatgaattgtttggcagcttcgtggatagagtttaaagaattgattttaatttccatattcattggtttgattgagtttcttttgtttgtaaatatacatgcttttccccattttacaaaaagtatagataaggattgaaaaaaagattatcgctgcacccgaaggaacttgtaatttataagaaatgaacagtccacctaaacaacctgcataaccaatgatgacagaccaccaaataattttcttgaaactatgggtaaacaaattagcggtcatttgtggtaaggtcagcagagaaatggcaagtactatacctaccatgcggagacatgatacgatggtcagtgcaatgaacatcattagaatatattcaaataaagctaccggtatacgttgagaacatgcgaattcccggtcgaaagcgatgcaaatgataggatttagaaataaagtgaaaaatagtatcaacagtatggaaagaatggcaagtaacaaaatatctgtgggcgtaatggtcagaatgttaccgaacagaaaggcggataaatcgggagtgaatcctggagctaaaaagctaaatataatacctactgccataccaaaagtccaaaacacagcgatagcagagtcttcgcgcatatctttccgtttgcttaaccattctaccccaaaggaagagagtacggagaagattgcagcagataatagaggagagatgtctgcgtataatcctagaccgatacctccaaaagaggcatgggtaattcctccactgataaataccaaacggcgcgtcacaatgtatgtgccgataatgccacaggcaatgctggcaaacaagcttcctagcaaggcatgttggaagaaagtataatgcaaaagttctaatatatccatactgtattcttttttcagtggtttttattcaaatggaggctttgcttgatgtagggcggattatttgaatcttcgttcacctacaatcaggaaaagttcgtctttcaactcgtctggcagttctactccacgtaattgcaggctacggctccatccggctacctcatcttctttacaagtgtacatgatttctcgaaattcttccacttcttcttcattataaccatttgagggacggccgcgaaagcggtccagttcttcatcatcataatattctatttttttgctgacagcggcaagcaggctttctttttcacaaatttcatgttgtccacaacattcagcgtctgcttccactatttcgggagcggtcttcaattctccgctttctatctttttttgtatctggcggttgtgtaaaactcccactgccatggcgatacctgccaaaataatcagaccaataataagtatgagcataactttatatctcctctattataaaaccagctttctttaaatcttcccaatagtaaggataggattttgaaacgacctgtgggttgttaatccggatttcgggcatcactacacaaaccggagcgaacgccatagccatacggtggtcctcataagtgtcaatggcggcatcagcggtcatttcacatcgttcaccttcccaagacagaatacgatcgtctatttcatgaagtatatatcctagctttcccatttcttttatcaaggctgttatacggtctgtttctttaatcttcaaactttgtaagcctgagaagcggaagggaatattcattaacgcacaagtgacaacaaatgtttgtgccaaatctggttggttgatgaaatcataatccagacgttcggctattttatcggtctttttcaatgttaccattttatttccataaatactttcgattcctagtaactggaaaatttcagccactttactgtccccttgatagcttgtttcgaataatcccggtaaaatgatttccgctttgttggaaagagcggctatctgataccaatatgaagctgcgctccaatcactttccacgtagaaaggtatggattggtagggttgtggctcaacttttagttgatattcattgagccatttggctttggctccaaagtcattcatcaactgtagggtaagattgatataagggcgggatataatttctcctgtcagtgtaagggccagcccgttacttagtataggagcaatcatcaataaggctgagatatattgagaactgatattgcccggcaggctgatggtatctttctgcagtttgtgtccggtgatacgcagaggaggatatccgtcattgattatgtattctatttctgctcctaactcacgtaaagcattgaccaacacctggatgggacgttgttgcatacgttgtgtaccagtgatgatccgtgttcccggagtgacggacaaataagcggtaagaaagcgcatggctgttccggctgccataatgtctatggtatttttgccgtcatttaaggcgtgaatcattacttgggtatcatcgcagtcagataggttctcaagttggaatgttctatttcccagtgcgttgataatcaatgcacggttgctgatactcttggaagaggggagctggatcgttgtatatatttgagcgggtgccgttacttttatttgcatcataccttatataatataataatgtgtatcggattgcaaaggtaggaatattatcttaatacttgaaggttgctacttaaaaaaggaagccgagagtataaaaaagccgagaacatggaaaggtggctgttttgttcccggcttggacatatagtgaaagttaagctatagtgatgcttgaatccaaataaacatcttgaatggtatttaacaattcaattccgtctttcatcggtttttgaaaggctttacgtccacttatgagacccatgcctccggcacgtttattaacgattgctgttattatcgcgtcttttagatcagaactgccatgagattcacctccagagttgattaatcctacacgtcccatgtatccattggctacttgatagcggcagaggtcgataggatgttctgaagtcagatcggtataaactttatcatttgtctttccaaatttaatggctgtaaaaccaccgttattgaccggtaatttttgttttacaatatccgctttgatagtaactcccaaatgattggcttgtccggtcaaatcggctgctgcatgataatctacgccgtcttttttaaaagcattattacgtaagtaacaccataaaatagtagccatgcctagttcgtgggcatattcaaaagcttccgctatttcaaccagttgtctgcggctctgttcagaaccgaaatagatagtggcgcctactgctacagcccccatattccaggcttcttttacagtgccaaacatcacttggtcgtaagaattgggataagtcaataattcattgtgatttagtttgacaataaaaggaatcttgtgggcgtatttgcgagcaacggaacctaatactccgaaagtagaggctacgccattacagcccccctcaatagcgagttttacaatattttccggatcaaagtaaagtggattgggagcaaatgaggctcctgctgtatgttctatgccttgatctacaggaagaatagatacataccctgtatttgcaagtcgcccgtgtcctaacagggcttgaagactgcttagggtacgaatattgcggtctgatgatatccaagtatcatcaatggtgtttggagaagggatatggattaatgatttatctatagttctacaggtgtgctctaaataaaatgctgcttggtcacccaataaatttgttattttactcatactatttttttcttttattgattaataattctttatccataatgttttctttctagtataaaggcgtatgattgcgcttgaatgcattattgaaaacactattttgatgtattctccattctgtgatggaggtttcggacagcgcaggaaaattatttcctgccgtcgggggtggtctttccttgatcggctactgcttccattagtttttttatttcttccggatctcccaaaaagtagtctttcttcaaattcaggtcatcatcaaactcgaacacatacggaatagcggtaggtagattaaggcctacaatttcctcatccggtatgtgtttcaaatatttaataattcctctgaggctgtttccatgagccactaccagcagttcgtttgctgtagctagattggggaaaatgatgcatttccaataaggtaatatacgttctactgtttctttcagagattcagtacgtggaagatctttgtcaggaacttctttataacgggtatctgttttcggattgcgcggatcgtcttccgatagggctttgggggctacgttaaagctacgacgccatatcaatacttgttcttctccatatttagaagctgtttcgcttttgtttaatccttgcaatacgccataatgtttctcgtttagacgccaacttttctctacaggtatccaatcttgatccattttatctagcacacagtttaatgttttgactgcacgctttaaaaaagaagtgtaagctttatcaaaatgaaatcctttttcttttaagagtgtacctgcttggttggcatcagcgatacctttttcggttaaatctacatctgtccatcctgtaaaacggttgtctttgttccaagtactttctccatggcggagtaatacgattcttttcatttgttctcctttctttattacccggtaatacattttctgttggcaacaaaattagttgtagcatacatacttatcaatacccattaattatgaatttaacaatggaaggcaaggatttgtttctctttttattatttttgtgctttgtaattaacacatgccatgaaaagaattaaaacaggactaacgggatttatattaggagattggttgggaatgccttacaggggaaaaggaaaagggacatttaaacctatatggacaaaatcttatcttcggggagataaatgttcagggaatacctcgatgttattatgtgctttggacagtcgttgcaatttggaactttatcagcagaatttaagaaactggtatttcaatagaaagtatacaggagaaaacattgagtttgatattgatcaggtgacccaaaaagcaatcatgaaaaatttcaggggagtgtcttcggattctaatagtggcaaccgcagtttgatggggtgttgtgttttggctttttctcctttatctaaagaggagattttttcttttattaagatcactcataatagtcgttatagctttaagtatacttggttttttattgagttcattcgttgcctgttggaatatgaagataaagaacaggcattacagcaggctgagcagagatgtgatgtggaggttaacaggcaaaatctttgtaatggaagctttgttgtagatacggtggaatcagtggtcaattggtttatggcaggaaatagttataaggagtgcgtattttcggctataaactcaggtaagtcaagtgatgcggtaggagcattgacaggtttgctggcgggaatatattatggattagaattaaagaatggagtgaaggggtttgaaacaatggaatcttatattgattcatttatccagtaccttaatcccactctttaaattccaatgaaagttgttcccattgtttttttatttcttctttttcttcttttggattagatatggatagtccgataaggcggatggggtggctttcataatcaatttctttcagtaatttttttgctaacggaagaattttatccatacttgtcagttcactgttttgagtgatgctgcgggttatttggctaaagtcatggaactttatttttaaagtaagtgtgttaccgctgaaattagtgcgtttcagtctttctagcaattcggtaactacatgatatagttcaatgatggcggaagaatgaagagaaatgtctttttccaatgtatgttcgcatcctacggacttacggattcttatgggttctacaggacggaggtcaatgcctcgtgcgaaatcgtaatacagattacctgctttaccaaactgccgggtaagcatttctaaagtgcaggcttgtaattgggtaccattatgaatccctaatgtgtgcattttttgggctgttaccggacctactccccaaaaagattcgatgggaaggtgggcgatgaaatccaatgcttggttgggatgtattgtacataatccgtcgggtttgcggtaatccgatgctattttggctagaaacttgttataagagaccccggctgaagctatcaatcccaattctttgcgaatacgctttttaatatctttggctatatctatagcaagtgaaaagcctgctttattttcagttacatccagaaaagcttcgtctagtgacagaggctctatgatatctgtataggtatgaaaaatatcatgtatctgctgggatacagttttatatacattcattcgccccggaacaaaaatcagttctgggcaaagtcttttggctttttgtgatgacatggcggaacgtactccgtaacggcgggcttcgtaactggcagcagctaccacacctcgttcttcagcgtgtcccacagcaagcggttttccacataattcggggttgtcacgttgttctaccgatgcgtagaatgcatccatatcgatatgtattattttgcgttcggacatcttcatgaaatttgtagagcaaaggtatgaaaaaggtttttggttgatgaactctttaacagctttatttgttatattttcattaatattatttctgtataacgagtatgagaaaggcacgtaaaaactactttatttacttgatgatgctattgatattcggagggttgatttataccgctatagcaggtggtgagcgttttttgcatttgtcatctataaagccagcgacagcaggtgatgatgcttttactatgtttaaaactatattacttgataatctggagcatcctttttccattttactcattcaaattatagttgtattgattgcggttcgtatttttgcgtctgcattccgctatatagggcaaccgggagtgataggtgagatagtggcaggaattgtcttggggccttccctgctgggatctctttatcctgagtttttcggctttttgtttcaaccggattctttgactaatctggaacttatcagtcagttagggttggtactatttatgtttgttattggaatggaggttgatttcggagtattgaaaaataagataaatgaaacattagttattagtcatgcaggaattttggtacctttcttcttgggaatgttggcttcttactgggtatatgaggaatatgcttcccagcaaacagcatttcttccatttgctttatttattggtatatctatgagtattaccgcttttccggttttggcccgtattattcaagaacggaatatgacacggaaacctgtaggaattcttacgatagcatctgcagccaatgatgatgtgacagcttggtgtttgttggcggttgtcattgctattacaaaagcaggaacgttgggaggtgctttgtatacagttcttcttacatttgtctatatagctgtgatgtttgttgttgttcgtccgtttttaaagaaaatcggtacactttattccaataaagaagttataaacaagacctttgtcagttttatatttttggttttgattgtatcggcggctattacggaaattttggggattcatgctttgtttggtgcttttatggcgggtgtagtcatgccttctaattttggtttccgtaaggtaatgatggagaaggttgaggatatagcattggttttttttctaccgttattttttgcttttacaggattacgcacacagataggattaattaatacgccggaattatggtgtgtatgcctgttattgattactgtagcggttgtcggaaaatttggtggatgtgctgtggcctctcgtttggtgggtgagtcttggaaagatagtttcaccataggtactttgatgaatacccgtggattgatggaattggtggcattgaatatcggttatgagttgggggtacttcctccatctatctttgttattcttatcataatggctttggttacgacttttatgacgacacctttattaaatttagtcgaatggggctttgcagtaagagaacaaaaaacggttttgcaacgaaaattgcttttgttctttggacgtcccgaaacaggtggtaagctattatcggtatacaaattactctttggaaaacaactttcttatcatcaggtaattgcagctcattatacaacgggtaccgatgtgaatcctactagtgttgagcaattttttgaagaaagttttattcctgttgataaacaggcagagcacttgaatatacatatagagaagcgttatagagtaactgataatttggtatctgatatgatttccactgtagaagcggagtcaccggatattttgttgttaggcgcagggcctcgctttatgactgacggtgaaaagtcgatgacttctttttttggtttgtttcgtaaaaaagtggatgatgtgttagagcatgcttcttgtcctgttgctatctttgtaaatcgtgactatcgtaatggagatgaagtggctgtattgataaatggaagtatggatagttttcttttcacttatgtgcgtcgtttattggaagatggagggagttttattcatttatattatttcagcagtggaagtgaagaatatgtaggacaaatatataagataaataagcagtatgcaaatagggtacatctgtatcctttggttgaaatagaggatttggtattgccgataattcatggattgcttattttaagctatgatacttgtgtggggattgctgccaatgaaaaagtctttaaagcgcttccttctttattggtcatgaaggatgcatcttaaaaagaaactgagccgttttcaaccatcccgccaaactgccatagttacgagaattgtctaaaaagcaaaaagcattgacaatcatcagattatcaatgctttcttccagtcggggtgactggattcgaaccagcgaccacacgccccccagacgcgtactctaaccgggctgagctacaccccgaattgcggatgcaaaggtagtgctttatttttaatctgcaaataaatcggtggaaaaatatatatgaatatcttttgttagtattgtatcttgcttgttatcagtgttatatatttttgttgcaaaatactgtttagataaaattctaaatagtattaaggtaacttcggaggctgttttgtaccctatatgatgcaaaacacatgcaaaaaatcctgtcttatagtagtagaaagcattaaatcattccaaaaccttaatcaaaccttaatcgaatattaaatgtgagaattggcaattaaaaaagggaaaataataaatagaagttaaagttggaacgaggttcccgaactaattgagcatttctccttggtaaccaaagttaatgatttaattttaatcgtcgaaattaatatctttgcattgagcgagagtgaagttctatactttactttgggacatcctattatgctgttcttataaagtataaaataatttcgtcggccatataactaaaaaaaagaacaaaatcatggcaaagacaaaaattgtgcttttcaaaagcaacattagaagggacggcagctgccccgtttgtttaagggtagcaaaagaggacaaaacaaagtacatcgacttacaactgtcggcaacgaaaggacaatgggatgaacaagcatcccgatttaaaaaagacaagcgtgtcaatcctaactacgaaaattacaatgcgttgctgaaccgttatgaagtccgaaaagatgaaatcctgcgaaagttcatggaggaacgggtacactggacgcttaatcagttcgaagaggagtttcttggtatgtcaaagcagggtaaggtttatgactactttatgcgacaggtggaaaacctaaaagccacaaggtatatcggtaatgcaaaagtctatgagcatactctgcatattctggcaaaatatgacgacaagattaaggagcgactattttcggagttggacgtgaagtacatcaatcggtttaacattgaaatggaaaaagacggctgttgtggaaacatccgtaaatactacctcaaaacattgagagcggttgtaaacaaggcgataaaagagcgtgaagcctcatcaaatacctatcctttcggtaagggtggctttgaaatcggtaagctggcagaggaaacagccaaacgctacctttcgccacaagatttggagctgataaaaaactcgcctcaacaaaatcctgtgttggagttatcccgtagggtgttcctatttatgtttcggtatgagttttatagacgaagccatgctgactaaaaacaatatcaatacgtttggggcagaggagcacatcgtttacaaaaggcaaaagacgcaaaacgctaaaaatgcaaagcctataaaaatacctgtaactcctgccataaaagaacaattggaatggtttaaagcaaatacaactttgacaggtaattatttgctgccaataattacaagggattatgaggggaagcaactgtatgaccatatccgcagccgttacaaacgtataaatgacggtttaaagcaattgggcaaattgcttcatatccgtatgaacctgaccacctatgtcagccgtcatacgatggccatgaccttacaaggcaatgatgtcccccgtgaatttaccagccaagcgttggggcatcgtaatcttacaacgacaaatgtatatcttgacagtttttcaacaagtgtattagacagagtagctaaaatcctttaattatgagtatgacaataaatatgcctttgggcgactttgatagacaagtctcccaaaggggaagcccgttttgcgcatgaggaatggttgcgcacctatgtaaaaagactgacgaaaggtaataagacaaagctaaaacaggctttaaatgaggtagatgaggctataaaccaatggtggaacggtttcttcatatccacttatgatgaaaagttatcagctgtccgacaaggcaaactgaacatggatagtcaagagttggaagacatctataacgaggaaacctatttacaaaaagagggcaaaacaggtttggttgcagatttcctgtatgattccatagcccaatacggctttatcaatgaacaccaccgtgatgcgatagagagcgcatggctgtttcacgacatggagtttttgcaacagcaatgggaatattacgctctggctcaaataaggtcgttgcgggcagtcattgtttccatgctgggaacagtaccaacgacacctgaaaccgaaccacagaatgccaaaagagagccaaaacggatagaggattatcccgaagtgtttgacattacactttattgtgaacttacgaattatgcaaaggatactatttacaagtggacccgtacccgtgaaataccttgtcatcgttccgggacaaacggacgcaaacttgtgttcaagcgtgacgaaatcgtagcgtggatgactgcccgaaagcaggaaaccaaggacgaatttataaaacgaatggaaagctagttggctgcacggctccgtaaatagttaatatgctttattatgtataactttctatatacattccaatctcacagccatgtatgacaaaatcaaattaatgctatatgacctgccaacagggtacaactggcaaacagtcctgcaacgtacagttgactattttgccaatggtacaggtggtaaggggtattggcttggacgtagagtcatagttatagacacgtatgtgtcattcgagggcatgtctatgaaaacataacctaaagaccttatcattaaaggaagtagagggacttatatgaggttaagtaaggatttgggtgtgcccatgtataaggcagtggtggagtctgcggagtttgcacataactttagcatgacagagcctcctattatgtatatgcagaagttggatgctatgaaagcatttagacctaatggttggagtggtactaaatatatggataacggggaagtgcgttgcaagttttatgacaaaatacaggaaacgaagaagaagcgtgaactgcctaaatatggaagagagaacttgccaaagaacttattgaggtatgaggtgacatttagcaccaaaggactgagtaggttgtttggcagggatatagtagcagaggaactttggagtaaacaggtgttttggacgctggttgcagagtggtttggatattatgaggatatggtgaaactgcctaatgattgttgggatgcggattaccgtatttttgagagcgccaaggactttgccaagtggtgcatttgtatagcaaatgccgaccaaaacctgtcttattatgtaaagcacgtcctttttaaacttcggacaaatccgcagccagccgaccgtgtcctacgtaggcaaatacaaaagaaaatctaggaagcgttggagtggggcaaaaaacatttggctctccctaacctgaccttggaactgacaggcaaaatagaacaatatcttgcttggctgttggagcagtcggcagacaggatgggcatcgcggaggaacgacgaatattcaataccgctgttaatcctcttcttattcaaataagacttggtaatcatcagagagtgtaaacttcacttcctaagtttattcttcagatgattaccaagccttatcttttaaatgaggtgtctattgggcgtgcacggccaaaaacttatctaacacaataaaagtactcggcaggatataaaaataattcgctaatattgcgaattgtgcaaatatgtgttatctttgtgtcatcaaagaacggttatatgaacgtagaatttgaaaaggaatatttggcagaactttatgaaaaaggaaaaactgatgataagaagcatcgtttccaacctcaaatagtcaatggttatttgaagtgtgtcaaagctctactaaatgcctctcgaatggaagatttatatcagtataggtctttaaactatgaaaagttgaaaggtgataaaaaaggactttcttctttacgcatcaatgaccaatacagattggaatttaaggaaatcaccaatgcgggtaatcaaacaatcatagaagtctgttctttgatagacattacaaatcattataaataggaggaactatgggtatagcaacaaataatttgcagtcattccgtccctatcatccgggtgaattgataaaggaagaattggaatgtagaggcataaggcaaaaagactttgcaaagagatttggcttgtcttattctgccttaaatgaaacattaaatgcaaaacgtccgataactaccgaatttgccttgtttttagaggcggctttgggggtcaatgccgatttgcttgtaagaatgcaaacggattataatatacaggtagcacgaaagaataacttcttgcgtgaaaagctaaacaatataaagaaaatagctgccgtgttttgaaaacagttcttggtatgatattatagaaataaagtttttaacgaggtatttaagataaggtggggcaagctgctccacccttattgtttgctcctctaagagtgtaaaaaagagttcctttgtactcgaaaatacttgtttaatagattgaaaatcagtaatccaataaaaattagcacaaatatttaaatctcggtcataaattcttcgttatattcatgcaacttataaaaagtttggtatgagaaattaattgtatttgtgttggaatagttatcttatacgtgatgctcctaattgtatatcagcgtgttattgtaaaatagttagtgatatacataagtaagttataatattaaaaaatgagattatggaaaacaaggaagtacaggcattagattctgaatatcttttgtcgttaatgaaacaggctaatacggataaggatgctgcatttgagttaggaaagtagtacatgaatggcacaaaaattcctcaagatacccgaagagtactcttttattttcaacaggctacagatttggggcattctgagtcacaaatgataagtggatatctgtataaagtaggagcatgggatttgaagccagaccctttaaaagctgccgaactctttgtgtgtccgtcaatgacaaaccccagtgatgaaattgtatagtgggaagctataaatttattcttatatggtggtattggaggaacacctctaaatgaatatagaggtgttagtctgttggtgtttatgagccaattggaaattccctatgcaatgtatttgttaggtaaggctcatgaaaacggtttatggggagtgtctaaagacaaagacgaggcgataagattatatcgtgagtctgcgaatttagggtgtactgctgctatgctatttcagccttaaaagaagagccttttgtggtgactgaacaataagcagagaggaggtgattatttgctttaccacttatttaatgtatttggaaaattcttcaatgcaataatgcaaaatccgcataataaaaggcaatagtcggataaaataagccaagtttcccgaaaaccttattcgtaaggtatccgcaggtaaaaaataaggagttaagtatttatttaactccttgatttatatattattgtaattttattatcggtaatcttattcaatttccccagacgcgtactctaaccgggctgggctacagcccgaattgcggatgcaaaggtacggcttttttgtatttgcaaatattctctgtacttttttacattaaaagtacatctttttatgcaaggtattgataaaactaataagtcgattccctatattcagagggagacatattggtgtgtcttttaaaaaaacgacctaaagcagactggttcaggaacttagttctgattgttatttcctgaatattaagagaactgtttttcaataattcttttatctccagtaatgaataatctataatccagtccttaggagattttccactggtttctttaactacttcagacaaatatttggaagaaacatgaagtttgtcggcataaaagataacctctttatgttctctgtagttatccatcattagcgtgtagaatctatgtgttaaatcttctttacgtgttgtacttgtattatttctatgattgatataattttcaaagtcattatataaatctaggaatataattcttagcagagctataattgcttctctggaaaaacttttgggaagtttgctccgactcttcagtaatgcataataattcatgaaatactgcatctcttgttccggcaagggataaaggaaacgagatttcatgtaagagaaaaattgaggagaaaaacttctgatagtttttattacatcatagaaaaatgtgtttgaaagtgtaaaatagtttgttgtgaaattaggacttgtctctatgactgagactagcaatcccggcataaagacaaaaacatcatgtggatgtatagtatattcttgagaatccattcttattttagcatttccttgtatacagattccaatagtacatataggggtgtaagaggggcaatctgtaatgggcaatgttgatgcatcagattgcatgcaaaattcattctctaatatatcttctctattcttttcaaattccttatataacatttataccaaccaattatagtgcaaaaataggatttctgaagcattgaaaagttgatcaatggtatttaggaacaattttacggaaaaaaagcactttgtatttgtcttttttaaatgataagcttggttttttaactaatatattataaatactctaatttcttgattgttaaaagtttgcctgagcataattggggataaataaaagatgttttttattgtatcggacagatggaaagattgtacaatctttccatctgtttaaagggggatcagcaacccatggattcacgataaaaatccagcatttcaaaaatttcgtctttacttgccgattggttaatctgtatatctcctatttcagttaatagggtgaaattaatgatgcctgctgagttcttcttatcatgtttcatgaattcatagaggcgttcatattgtttgcaatcaaaaggcataactccataatgttctttgatgaacaagatggtttgacgtagcttgtctttgggaaaacctgttttgatgtgggagaaataaagttcacaaactatcccccatgccacagcgtaaccatgtaatataggatgctgtgtctctaatgccagactttcaaaagcatgccctacggtgtgtcccagatttaaagctttgcggattcctctttcaaaagggtcctgttccactatattttctttaatctgtacagattttccgactaaagtctgtaagaccttgtaatctatattgttgaagtcaaatctcagcaattctatccaatgatcatgggtgctgataagaccatgtttcaacatttcagcgtatccggacaatagatttcgaagatccagtgattttagaaaatcagcgtcaatcaatacactttcggcaggagagaagactccgatctcattctttaatccgttgaaattgattccggtcttgcctcctacagatgcatcaaccatagccagtagcgtggtaggaatattgatatatttgatccctcgtttgaaagttgatgcggcgaatcctcctaaatctgtaaccatccctccacctaaattgataagtaacgaatgacggcttgcgcctttatctcccaactctttccatacatatgccaatgtttccaagtttttgtgcacatcttcggcccctatataaataaaatgggcatttttaatacaatcaaatccagataaaacaggaatgcaaagtttacgcgtatgttcatcagccaagacaaataatttgtcatgtgggcattgggttattgccttattgagattttcttctaagttatggcagataataacttcttgtttactcatattttctattatttgcctgcaaatttaggtaaaaaagcaaaaagatgaccgttctttgcttacaaataattacttttgtacgttaaaatataaaataatgaaaggaattttaccggtttattgtaggacgatgggatatgttgttctgttgttgtctgttttcgtaccgttgctcatgtttatgtttggcatgataaatgatagtaacttgttgtttacaaaggcttctatcaagttacttatctggttttctctgtttatgatcttcttggcaaaagtgaaggatgagaatgagaagatttcccgaatacgtgtcaaggctatttgttatgctatttatttgctgggcatttattatattgtaatgttggtcagaggagtatataatggaaatctggaagaagcggataattccattgctatagtttatatggcttttaatgttatttgtctggaatttggcgtacaaaaaagccgggttgaccgattatttaagaaataaatacatttttccgttaaaccttttgttgacaagagtgtccaaaggacattaggcattaaaatttcaaggaaaaaaatgaagaagttaatattattgttgttactggtatgtacctgtgcaactctctcttgggcgcaaagtggcaagcgcataaccgtgacgggatctgtgattgatggtgatgataaaagcccggttggacaagctaccgtacaattactttctctacccgatagtacaatggtggtaggaaatgttaccaataacaacggagtattctctattgccgcccgtccgggaaaatatgtacttaaaatttcatttgtaggttatcttactcaggaaaaatctttgcagctgacagctggtaaaccgagcgttaatattggaacggtcactttacctaccgatgctatcatgttgggtgaggcagttattgtagccgaggctccgcaagtaaccatttcagaagatactattggttataatgcttctgcttatcgtactcctgagggggcaatgttggaagagttggtgaaaaaacttccgggagcagaaatagatgacgatggtaatatcaaaatcaatggtaaggaagtaaaaaagattatggtagacggcaaagagttttttggtggcgatgtgaagaccggtttgaagaatctgccagtcgatatggtggaaaaactgaaaacatatgataagaagtccgatttggcacgcattacgggtattgatgatggtgaggaggaaacagtgctcgatttgacggtaaagaaggggatgaatcagggttggtttggaaatgtggatttggcggccggtacggaagaccgttatgcgggaagagctatgattaaccgtttttatgataaaactcaattctctattattggttccgccaataatgtgaatgatcagggattttcgggaggaggacctcgttggaggcgtaacaatggattgaacgcaactaaaatgctaggagcgaattttgctacagaaacagaaaaaatggaagtgggaggtagcatgcgttacaactatcgtgatgcggatgtagtaacagtaggatcttcacagcgttttttgcagtcgggggattcttattccaattcaaacaaagccgatcgtaataaagtgactgatttcaatgcggattttcgtatggaatggcgtcccgattcaatgaccaatattatttttcggccgaatgtttcttataataaaacaaaagggacttcggcaacagaatcaggaacttttaatgaggacccttaccaatatgtggtaaatcccaatgattatctgaactttaacaatataggtaccgatgacccgttaagggatactcgtattaatgctaccaatgaacacaatttgtcaaaatcaaatagtttgtcggctaatgcaactttacagctgaatcggaaactgaatgataaaggacgtaatattacattccgtggttcgtttggatatggagatgatgacagcgatcagtatgctcaatcggaaacccgttattatcagataaagaattatttaggaggggactccattgaatatcgtaatcaatacattacgatgcctactaaaaattataattatacagcacaatttacttatagcgaacctatagcacgggctactttcctgcaatttagttatagattccaatataagaatagcaagagtgataaatcgacatatgatttggggtatccttggaatataaatgacggattacccgaagactatgaaactgcttatgtagatagcttgagtaaggatgctgaatataaatactttaatcatgatatctctttaggactacgatttatccgggagaaatatcagttgagtgccggcatgtccttacagcctcaaaatacgaaattgtcctataagaagggagattacatgactgataccacaagaacggtattcaattttgctccgaatctggattttcgttatcgcttctctaaggtaagtcagctgcgtatcacttatcgtgggcgtagtagtcagcctagtatggaaaacctgctgccgattgtcgataattccaatccgttgaatatccgtgtgggtaatcctggtttgaagccttcgtttgcccataccatgcgtttgttttataacacttataatgccgagaagcagcgtgggataatgacccatgtaaatttcactgctactcagaatagtatcagtaatagtacgatatatgatgagaatacgggtggtactacttcaactcctcagaatatcaatggaaactggaatgcgtttggtatgttcggttttaattcggctttgaagaataaaaagtttactataaattctttttctcgtgttaactaccggaatcaagtagcgttcttatacaataaggaaacattgcatgatgataagaatacgactaccggcttgactttggcggagaatctgaatgggtcctatcggaatgactggtttgaattttcattgaatggttctattgaatatacagcggaacgtagcaagctgcgtcctgaaaagaaccaaaatccttatacattctcatatggagcgagtaccaatgtcactctaccatggcagatgacattgtctactaatattaccaatcagtcccgtagaggatatgatgatgccagtttgaacaataatgaactgatttggaatgcccaaatagcacaaagtttattgaagggagcagcaactgttagttttgaaatgtatgacattttaaaacaacagagcaatatcagccgttctttgactgcagatgtacgttcggttaccgaatacaacagtatcaatagttactgtatggtgcattttatctatcgtctgaatatttttggaagtaaagccgctcgtgacaagatgatgaatagccataggggattcggtggtcccggttttggtcccggtccaggaagacatggccggcgtcctttttaaatgaaactatatcttaatcttttcccaatctatattgttataggttgggattttttttataagtttgcttataagtaaattacttggaattatatggtagagtggagtatctttaatgaaatctttgctgttgcttttaacgtgctttattttgtgattatcatcggaactatctttatagtgatacttgataatcgtaatcctgttaaaacaatggcatgggtacttgtactctttttcctgcccattgtggggcttgtattctatttctttttcggcagaagcacacgtaaggagaaattgatcagcaagaaagggttcacccgtcttataaaacgtcctatggcagaataccaagcgcaaaaggcgtttaagtgtcctgatgaacagtaccagttgatgcgttttttccggaaagtgaataatgctttgccctttgaaggaaatgcgacggaagtttttacggatggttattccatgctgtattcattgatgaaagaaatcagtaaagcaaagcaccacatccatttacagttttatatttttgaggatgatccggcaggcaggctgctgcgcgatgtgttgatagataaagcgcggcagggagtagaagtgcgtttactatacgatgacgtgggctgttggaaagttccccatgctttttttgatgaaatgcggggagcaggtattgaagcacgtagttttttgaaagttcgtttccctttatttaccagtaaggtaaattatcgtaatcaccgtaaaatagtggtaattgacggtcgtgtggcttatatgggaggaatgaacattgctttgcgctatatgaaaggctttccatgggggatatggcgggatactcacattaagatagaaggaaaagcggtatatgggttacagactgcttttttgaccgattggtatgtggtagaccgtactcttatcacttcctcccgttatttccccgaagttggaatctttgggaaggctctgatacagattgttacttccgatcctgtaggcgaatggcgggatattatgcaagggttactgatagctatcagtagttcccgaaaatatttttatatacaaaccccttacctgttgcctaccgaacctattctgatggcattgaaaacggcagctttagcaggtgtggatgttcgcattatgataccggcacgtgccgatacgtggataacacatttaggttcgttatcttatttggatgatatcatgcgtgcgggtgtcaggatttacctttatcagaaaggttttttgcattccaagttgatggttagtgatgatactctctctacggtaggttctactaatatggacttccgtagctttgagcataattttgaggtgaatgcctttatgtatgatccggcctcagcattgatgttgaagggtattttcctgcaagaccagaaggacgctatcctgttacagagaaaaacatggatgaagcgtccttggtatcaaaaagcacaagaatctattgttcggttgctggcaccattgctttgaagaaagagaagttcacactgccatatacacggcgctcaataaaatggggattatcctcgaaatggttctctttgccatgttccaataccaataatccgtcttcctttaaaatcccgctttcgaaaatacgggtggggatactttccagatctttcaaggcgtatggaggatcggcgaagatgaaatcaaactgctcgttgcatttgtctataaatctaaagacatcagcacggataggaaaacatttgtcagtcttcacttcacgcatcacctgcgagatgaaagaaagatgctggggatctttttccactgagataacccggtcacaaccgcgtgaaaccagttctatactgatgctgcccgtaccggcaaaaaggtccaaagctgtaactccgttctcgaagtcaaaataattattacttaatacattgaaaaggttctctttggcaaaatccgttgttggacgtgccttgaatgtatgaggcacgtcgaaacggcgccgtttgtatataccgctgattactcgcataataataaggtttgcatgtcaaaaggtatctcttctattttacttatctcggagcggttgaattccgctttggggttgatgacgaatacctgacgcagatagttgcgcaattctttcaataattcttctttgtcctctaattttcctgtcaagtgcagttcgtctttttcctgattataatttaattgttgccatatatataataggtaatacacacggtctgtggtttgtttgcatggaaatgagttaatcagtaataagttgcccttatcaaaacaaaaaacttccatttgttgctcgcgtatgtgtgtgtatagtttccggctgttgcccaaccggcttttccgggcgaaatattcagtcagcgggctggcggtggagaagtaacgagctgtaggaaaatgttcagtcagtaacaaatgggtatgtttgtctatagcaaaaagtattaccacattactccttcccagaacattgcaaagtacaatctcgttatttcctttaggaaaattatgatagaaaacagtatccatttgttcgtcttcgaataattctaaaggaacaggtgtgaaacggggggagtcatacagaatgttaacccgtttatacggatatcttagagtttctgtctcggttaacatttcctttagattagccgtcatagagtatccggtattgacaggatacggaacaaagcagaaatcattatctgtcagtgggttatagatagaaaaagaaaatccatccgcactgaggcggatggataatgtatattgttccgattttgtaaaatcgatacgttcagtcattcttattcccagttacctgcgttattgttaggctgttcgatatcacccactcttaaaccgcaatatttgcccagtttggtttgaaggtctttaaggttagccaattcttgagcattcaaaccacccaaatatgtttcatacggagtttgagcttggaataaatgcaaaggggcacctgattttgttgtatcgttacggatagccatttcaaactgtgcaccatttccgaaaggaacatatcttaaagagtctgcattgaatcccggagcatagattgtatctgttacggcaacccataaagtatcacgtttgaagttcattaaaccttctttttcaacttctttccagttaccagtttttttggctttgttgatgattgccatagctttcttttcagtcatgccagcttccaattgcgtatcagacaaaactccttctttctttacaaatggaagttttgcagttttgacgaaatcaatcaaggtgtcgaaacttgcagtgtattgtccgttgtgcaggttgcggtattccaactgtgccttacggatgtcaattaagcgtgcaataacttgtttctctctagcttttttagcgtcatcgaagttaatcggtcccatgatactgccgtagcaaacgtatatcaaaccgataacgcaagcagccaatacaatattaataactgttttcatgataaatatgtgttttttttagtttatattcgcatcgcaaaaataaaacaaataaatctaataacgcacagttcaaggaactttttattacgcaattatgattaatagttatttagtgcagcaaattaagggaaattttctatataaaccaactttagaacaagaaaaagctgttaaatttttagcagattttctcttttcccaccaatcggactcggtttttctcttaaagggatatgccggtacgggtaaaacatcccttatcggggcattggtgaagaccttggaccagttacagcaaaagtgtgttctacttgctccgacgggcagggcggctaaagtcttttcacattatgcacagcatccggcttatactattcataagaagatttaccgccagcgcaacttttcaaatgacctggataacttttctttggatgataacttgcatcagcatactttgtttattgtggatgaggcgtcgatgatcgctaatgacggattggcgggggcagtctttggtacagggcgtttgctggacgacttgattcaatatgtatatgccggaacaggttgccgtttgatgctggtaggggatacggcgcagcttcctccggtaggagaagaggagagtccgtctctttcggccgataagttacgcgggtatggcatggaagtatatgaggcgcagctcactgaggtggtccgtcagatgcacgattcggggattctttggaatgcgacagaattgcgccgctacatatccgcggaagattttctcactttgccttctgtccgtgtggaagggtttccggatatccggatggtttctggtagtgagctgattgaggttattaatgattgttacggtcaggcaggtatggacgaaacgattgtggtctgccgttccaataaacgggcgaatatttataataagggaatcaggaatacgattttgtttcgggaggatgaactgaacagcggtgacctgctgatggtggcgaagaataactatttttggacggagggctgtaaggagattgattttatagccaatggagatatagctgtaattcgccgtgttcgtcggatgcgtgaggcatacggctttcgttttgccgatgtggtgctggcgttccccgactatgatggtatggaactggaggtgaaacttttgttggataccttgcatactgaaacacccgcattgcctaaagaattgaatgacaagttattttattcggtattggaggattatgctgatataacagtgaaacgtgagcggatgaagaaaatgaaagccgatcctcattacaatgccttacaggtgaaatatgcgtatgccgttacttgtcacaaagcgcagggtggccagtggaaacgggtctttttggatcagggctatatgacggagaatatgctgactccggattatttccgttggctgtatacggctttcacccgtgctacggaaattctgtatctagtgaactggccgaaggagcagacggaataagcagacagtcagtgaggtgttaatgactgattatatgcttccagccgtttggttagtttttttttccttatggctaagcttttttgaacgtttatgttctatctccataacctttggagttaactcccaagcttatggagttgactccaaaggttatggagataactccaaaggcttgggagatagaaatcttcttttctgtttcccttatccatagaggagaaaaggcttagtgaaccagatgaaaaaaactccgccaccggctttcagaccagaatggcggagttttgatatatacgaaatatggacgaaattcgaatagattacaatgcagccagctctatcactttatcaacagccgcattcaaaccgtcaggattcttaccgcctgccgttgcgaagtggggctgaccaccgccgccgccttgaatcagtttggctgcttcacggaccagtttgcctgcattctgtccggcttttaccaggtcttcgctaatcatgacagtcagcatcggtttgttattgtccacactgcctattacaacgaacagattggcaggaatttcacctttcagctggaaggcaatatctttcactacgtcggcagacatcggaatgatggctttcaccactttcacaccatttatttctttggcattctctaccagtctggctttcagtgcggcgcccttttctttcatgaactcttccacctgcttcttcaatcctgcattttcgtcaatatacttgcggatggcgactttcagatcgggagcattgttgaacaatgccttcaagtcattcagcgtatcctggaccgtatccatcaattcctctactttggcacccgtgatagcttcgatacggcgcacaccggcagcaacagagctttcgctgataatacgaaccataccgatcttgcctgtagccgaaacgtgggtacctccgcagaattcaatagagttgccgaattggacaacacgtacctcatcaccgtatttttcaccgaacaaagcaatggcacccagttcttttgccttttcgataggaagattgcggtattccgtcaaagggatattctcacggattttggcatttaccaaatgttccacttcacgaagttgctcgtcagtcactttctggaagtgagagaaatcgaaacgtaatgactcaggagtcaccaaagaacctttttgttctacgtgagttcctaatacctggcgcaacgcttcgtccagcaagtgagtacaagagtggttggcggcacaggcggcacgtttttctgtatctacacaagccatcatcggaacgtcaaggtgttcgggcagttttttggtgatatggataggaaggttgttttccttcttggtatcaatgatttcgatggtttcgaattcgcttacgatcacccctgtatcacctacctgaccaccactttcggcatagaaaggagtatcgctcagtacaatttgatacagtgtctggtttttctgcttgatctggcgatagcgcaggatgctggtttcatattcggtaaagtcataacctacaaagtgggtgtcaccttcctttatggtgatccagtcgccagtttcaacggctgccgcgttacgggcgcgttctttttgtttctgcatttcggcgttgaactcttcttcgtttacagtcatgccgttttcgcggagaatcagttctgtcaggtcgagggggaaaccgaaagtgtcatataatgtaaaggcatccacaccgctgatctcttttttcccggcagctttggcatcgttcatagtcttgtccaacagacggatacctgtttccagtgtgcgcaggaaagattcttcttcttctttgatcactttctcgatcagtattttttgtgcgttcaactctggataggcctcgcccatattctcaattaatacaggcagcagcttgtacatgaatgcttgtttctgtcccaggaaagtatatccgtaacggacggcacggcggaggatacggcggattacatagccggcttttgcgttactgggcaactgaccgtcggtgattgagaatgcgatggtacggatatggtcggctataacgcgcatggcgatatctttctggttgtcttggccataggtggttcctgccatttcggcgatggctttcagcatcggttggaacacgtcagtgtcatagttggatgtcttgccttgcagtgtgcgcaccaaacgttcgaatcccataccggtatcgattactttggcgggaagaccttccagtgaaccgtctgctttgcggttgaactgcatgaatacaagattccagatctcgattacttgcggatgatccttatttaccagttggttgccggggatttgagctttttcttcttccgaacgtgagtcgatatggatttcagaacacgggccgcagggacctgtatcacccatttcccagaaattgtcatgtttgttgccattgaggatatggtctttcggcaggaactgttcccagtaagaggcggcttcattgtcccgttccagtccttcttcgggacttccttcgaatacggtggcatacagatctttcggatctattttcagtacatctaccagatattcccatgcccagccgatagcttctttcttgaagtaatctccgaaagaccagttgcccagcatctcgaacatagtatggtggtaggtatcatgtcccacttcttccaggtcattgtgcttgccgcttacacgcaaacatttttgtgagtccgcaactcttttgtatttggccgggtgattgcccagaataatgtctttgaactggttcattcctgcattggtgaacatcaatgtggggtcatctttaatgaccatcggagccgatgggacaatctggtgtcctttcgactcgaaaaagcttttgaaagaatctctaatttctttagctgtcatcatgtcgcttaatatattgtcttctagttaatattctcaaaaaggatttgcaaagataattggttttattatttttgtcgacaagaattgtgcaaaatattgatgtgttgtgcattaaaaacttcaaaaagcagaattagatgcgtaaagtctactatatttataatcctaagacccgaacttatgaccgcatttaccccacagtgaggcagcgcgccttaagcatcttgcgccgtttgtttgtaggaatgggcttgggggcaggcagtttcattattttattattgatctttggttctccgtccgagaaagagctccgtatagagaatgctcgcttactggcccagtataatgtgttgtctcatcgtctggatgaggctatgggggtgatgcaggatatccagcagcgtgatgataatttgtatcgggtggtgttgcaggccgatcctgtttcggatgctgtccgtaaggccggttatggggggacaaaccgctatgaacagttacgggatatggcgaatgccgatctggttatcaataccactcagaaactggatatgttgaaccggcagctttatatccagtccaagtcttttgacgaggtggtggatttgtgtaagagccatgacgagatgctgaaatgtattccggccatccagcctgtttccaataaggatttgaagaagacggcttccggttacggtgtccgtatagatcctatttataagacaaccaagtttcatgcggggatggacttttctgctagtccgggcacgccggtgtatgccaccggtgatggtgttgtggtgaaggccggatgggagacaggttatgggaataccatcgaagtgaatcatggctttggttatcttacgcgctatgcacatctgagtgcttacaaggtaagaccgggacagaaggtggtcaggggtgaagtgattggagctgtgggaagtacaggtaaaagtaccggacctcacttgcactatgaagtgcacgtgaaaggaaaagtgcagaatcctgtgaattattatttcatggatttgagcgcggaagattatgataagatgatacagattgcagccaaccacggtaaggtatttgactagccgtgaatttttaattctcaattttaatttaccatggtctataatcctaataaagaactgaaactttactattccataggggaagtggcaaagatgtttgatgtaaatgaatccttgttgcgttattgggaaaaggaatttcctattatttctcccaagaaggcgggagggaatgtccgtcagtatcgtaaagaggatattgagaatatccggctggtctatcatctggtgaaagagaaagggatgactttacagggggccaagcagaaactgaagatgaacagagaaaccactatccgtactgcggagattttggacagattgaaactgatacgtgaggaattggttagtatgcgtaaagaactggattatctgacttaagaatattcaccacagattgcacggattaaaaacgagttgcggataatcgttatgaacaatcagtgtagtctgcggtgaaattggtattggttaattcggctggtcttcgaacttctcgatacgggtgacggtttttatctcatctatctttcttagattggtagtgatggattttacatcatccacatcgtgtacaaatagctgtattcttccttcaaagataccgtcgttactttcaatattcaacttgtggatatttacattcaattgttgtgaaatgacttctgttaccttatttaacagaccgatgtggtcaataccttttatgtagatatttacaggaaagtacaaggattttccagtctcccattggacagccaacaggcggttgccgtaactgctcttcagtttggtagccaacgggcattggcgtttgtggatgatgatacgattattgtcgcctatatatcccaaaacgtcatctcccggaataggcttgcagcattcagctatcacatagttcttttggatagcttcgggagtcagtttcaatattttcttgctgtctatcttttgtaagggttccttctcttctgtcggtttctccttgtttgtcttgctgcctccgaaggcgaaagagatatactttttccagttactggaagtcggtttgtctttcagttcgttcttgtcgttttctcctagaatgattgtttttaatccgatggcggcaaacaattcttcctgtgttttgatggtatgcagattacagatctttcgtatattttcgggagtgtactctactccttccctggaaaagaattcccgtaacatttcctcaccggcctgctgcatgcctcgctgttcgcgtttcagtatggccagaatcttggctttggcctttgcggtggtggcaaagtttatccacgaaggctgtacatgctgtgatttggaagtaagaatctccacctggtcgccactttgcagtttgtggctcaagggcaccagcttgtggttgactttagctccgatgcaatggctgcccaagaatgtatggatggagaatgcaaaatccagtgccgtacagttttgcggcattgttttgatttcacctttcggagtgaagacaaatatttcagaagcgaacaggttcagtttgatggtatccagaaagtccatggcatccggttgcggatcgtccagaatctccttgatggtacgcagccatttttccagttcaccctcgtcctcactgcctccgccttctttatatttccagtgtgcggcaaagccttgttcggctacgtcattcatccgctcactgcgtatctgcacttctatccattggcctttgttactcatcagggttacgtgaagtgcctgatagccgttggctttagggtggcttacccagtcgcgcaagcggtctgggtgcggtttataaatcttagatatggatacgtatatgttaaagcactcattaagttcttcttccggatttttgggacagaaaatgatacggacagccaggatatcatatatttcttcaaatgtgatatgcttggtctgcatcttgttccaaatggaataaggggattttactcgtgctatcaattgataactgatacccattttgtccagttgtgcgcggataggtgctgtaaattcacggaatacttcttcgcgttccgcttgtgtttcttgtagcttggattctatctgtgcatattcttccggatgctcatatttgaaactgagatcttccagttctgtctttattttgtttaaccccaagcggttagccaatggcgcatagatgtataaggtttctccggcaattttgtattgcttgttgggaagcatggagccaagcgtacgcatattatgcagacggtcggctattttgatgaggataacccggatatcatcactcatggtcagtagcaatttcttgaaattctcggcttgtgcggaagcccggtctccgaatataccgccggatattttagtcaggccatctacaatctgtgcaattttaggaccaaacagattttcgatgtcttccacagtgtagtctgtatcttcaactacatcatgcagtaaagccgaacaaatggaagttgatcccagtcctatttcggtacatacaattttagcaacggctatgggatgcatgatgtatggttcacccgagcgtcgttttactcctttgtgtgcttgtttggcaaaattgaatgcctttgtgatgatttctacttttttacggtgtttggtcgctagataactgtccaaaagttcctgaaacccttggtttatcatttcctcatccgcctgttcctgagtctgcttttcatccgtcatatctttgcctcctataatctatactgcaaaaatatacaaaaaacatattcaagcaagtattttcagaaaatgtatagtgttaaatctgtattttttatcaatcatctgatccgcaaactttttccggctctgatattattgccctttataccgtttagattacgtaattgactgatggatacgtggtatttggcggcaattcctcccaatgtgtctccttgtttgattttatgataaagagttcccttggatgagcggtttctgctactggttgtttctttgatagctaccgtttttcttttggtcagatattcattgggtttataagcgaatacactgtcttggcggtcaatgaaagtactgacaaagttattgggcaaacgaagtacacacaactcgctgttaccgggaataatatcctttttgtattggggattcaggctgcgaagctggtcgaggttgatgttgcatacttctgccacttgttgtaagtggaggtctttgtttatgtgaatggtgtctgtagcgttggggagctgtgtttccatgggacagatgtcatgttcgcaataataagtcatgatgtagtttgctgcaatgaaagcaggaacgtacccacgggtttctttgggcaggtagttgtagattgtccaataatctgtggctcctccggcacggcgtatggctttgttgatagtgcctggcccgcagttgtaagctgccaataccaggttccagtcttgatagatgtcatataagtctttcagataacgtgccgccgcccaagttgatttgaccgggtcccgcctttcgtctatcagactattgcttttcagcccgtatatttttcctgtacccagcataaactgccacaaaccggtagctccctggcgggaaactgcaacaggatttaaggcagattctataaccggcagatatttcagttcttgaggaaggtcgtataaatcaagtgcttcttcaaagataggcatataaaaattggttgccgcaagcataaaggatactttattgcgcagacggacggcatacatatcaatgaatttgcgtacagcctcgttgtaaggcatttctatgatagaggggatacgtgacagacgatccatatagatggaatcacttacaacagggttggtagaggccattgtgcagttctctcccaatgtgatgtaattcttagattgccagtcccagtaaagactgtccatttctgactgcatactttcaggaacatcaataatttcttcttttcctgtagtttgcgagtgaacggtaatactttgggtttgtgcgttgattcccgttgttcctataaatgtaaataaaccaattaaaaagtttttcatgcgattaaaatttgaagctgcattgcaggcctattgtattaggtatcctgctccggccatcattaaaaataacaggttgtatttgaagacctaagtctttggatatatcaaaatcagatagttcagcatccacgtatgcgtctatgacagatagtatatatacaccgataaaacagaatatgcttaaatcccgatatcggcgataaaaatcttttcgttttttaaaggtatcctccataccttccgcactcacgccatgaggcaggaagtcttcgtagcttttggtattagggtcatcgtccataatatccagataggcttgcgaatagtccttgtacattctgttgttccaggtcagcgcatatgcacatcccacaaatcctccatatactatcggcagtttccaatatttacggttgtatatctgtcctccgccgggaattaccaacgccagccagatggcacggttggagttcggaataaatcggggttttgtttcggcagccattgctttctgtatggaatcatttttacggactaaagcggcagtatcaacaggtgcttccatattttctatcttttgtcgttcttccaacaattttaggctgtcaatgacaagtgaatctttgacttgtatgatagaatctgcctttatacccatacggcggttgcgtgccttttgggcgtgaacattcaggcttccagccatcataaggcataaaagcatgaatgtaaacactttatatgtggatgtttttcttttcaatgtagtaataacgctttattctttctttttcagtgaatccaatatttccatgattcgttccaagtcctcttcgttgttgaacggaatactgatcttgccttttcctttggctgtgcatgaaagctgtacttttgaaccgaagaatccgcagagatggctttgcagcaaagtgtattcctcggatagtttggaaccttttggtttgatcttcttcccaccgctgtccactgtctcgccactgctcagtgccttgacaatttcttccactttgcggacagaatagccttgtgactgtatttcattaaagatacgtatttgggtcttaggatcatctaaggacaataaggcacgggcgtgtcccatgtctatttcgcggtttttcaatgctacttgaatctgagccggaagtttcagcagacgcagataattggcgatagtggtacgtttttttccgacacgttcgctcagccgttcctgtgtcaatgcatattgttccaataaatgttgataagccagtgcaatctccaatgaattcaaatcttcacgctgaatattttcaatcaacgccatttccattacattctcgtcatcggctgtgcggatgtatgccggaatagatttaagtcctgcctgtatggaggcgcggtaacgacgttctccggctatgatctggtaagagtcttcactcagttgacgcaacgtaatgggttggatgataccaatttcggcaatagagtcagccaactcctgtaacgccaccggatcaaattcacggcgcggttggttagggttgacggatattttgctcagttctatctcattgatagaagatgagccggctgtctttacttcttcggtcgagatcagtgcgtcaagcccgcgtcctaaagcaaattttttctgtactgccattgtttactttctgttacgtgttataatttcttgtgccaatgccaaatgattcttggctccggtagagtcggcatcatacaatattgcaggaatgccgtggctgggagcttcgctcagtttgacgttacgctgtacaattgtcttgaataccaattcttgaaaatggcgtttcacttcatcataaatctggttggccagacgcagacgtgaatcgaacattgtcagcaggaagccttctatttccagtgaaggattcagtttcgatttaataatcttaatggtattcagcaatttgctgatgccctctaatgcaaaatattcgcattgaacagggataattactgaatcggctgctgtcagcgcattgatcgttatcaagcctaatgacggggagcagtctatcaggatatagtcatattcgtcccgcatgggggctaatacttttttcatgatcttctcgcggtcttccaggttcaacatttctatttctgcgccaaccaggtcgatgtgtgaagatacaatgtcgagtccgtcaatgtcggtggtataaattgcttcccgtatatcggcttcgttgataatacattcatagatagagcattctacctctttgatgttcacacccaatcctgatgatgcgttggcctgagggtctgcatcaataaccagcacttttttctccagcgttgccagagaagctgcgaggttaatcgttgtggtagttttacctacgccacctttttgattggctaaagcaataatttttcccatattaatcagtttttctcgctgcgaagtaacaaataataggtgattgtacctataaaaaacggcagacattagcaaaactgttgataactcattggttttgttaataactcaacggcggcaaagatagaaattttcattcaattctattctatttttagcactgggttgtagaacattaagataattttcttttctggcgaggggtagttccggcaaagagttgtatctttacgctccgagaaaaagagtggaaaaatatgaagagagaaaaaccgttgatattgctgtcaaatgatgacggcgtggaagctaagggattgaatgagttgatacgtgggttgcgtggagtgggtgaaatgatcgtaatggcgccggatggtcctcgttcgggagcttcgggggcgatcacttccgaacatcctgtgcggtattacaaggtacgtgaagaggaggacttgactgtgtataaatgtacgggtacaccggtagattgtgtgaaactggcattgcatacagttgttccccgtcgtcccgatgtggtgataggtggaataaaccacggtgataattcttcagtgaatgtgcattattccggtacgatgggggtagtgattgaagggtgcctgaaggggatttcttctatcggatattcattatgtaatcattttgcggatgctgatttctcttcatcgctgccttatatacgccgtattactgagcaggtcctggagcatggcttgcctttgggtatttgcttgaatgtgaactttccggatacggcttctttgaaaggggtacgcatctgccgtcagacgaatggggcttggattaatgaatggaagcgtagtctgcatcctcggggtggagagtatttctggctgaccggagagtttgataactatgaaccggaagcggaagattcggaccactgggcattagggcatgggtatgtggcggtaactcctacccaaattgatgtgaccgcttatgggatgatgaatgagttgaaaaactggaatctggaagtatgaaatactatttgatagtaggcgaggcatcaggcgatttgcacgcatctaatttgatgtgtgccttgatacaggaagatccggaagcagaattccgtttctttggcggggacttgatgacggctgttggtggaacgcgggtgaagcattacaaagaactggcttatatgggttttatcccggtgttgttgcatttgcgtactatctttcggaatatgaaagaatgtaagcaggacattgttcgttgggctcctgatgtagtgattctggtggattatcctggctttaacctgaaaatagccgagtttataaagaagcagacgcaaatacctgtctactattatatttctcctaaaatatgggcttggaaagagtataggattaaaaatatcaagcgggatgtggacgaattgttttctatcctgccttttgagattgagttttttgccggacatcagtaccctgttcattatgtgggtaatccttgtgtagatgcagtggatgcttattgtaagaaacatccggatgggtttccggaatttgtggcggataatggtttgtccgaaaagcctgttatcgcattgttggcgggcagccggaaacaggaaatcaaagacaacctaccgatgatgctggaggctgctgctccgtttaccaaagattatcaattggtgttggcaggggctccggggatggaccctgcctattatgcgggttatataaatccgaatgtaccggttaaaatcattttcggacagacttacaggctgttgcagcacgcgcaggcggcattggtgacttcgggtactgcaactttggaaacagctcttttccgtgttcctcaagtggtgtgttactatactccggtagggacgtttatcgcttttcttcgtcggcatattctaaaagtgaaatatatttcgttggttaatctggtagccgataaggaagtggtgcgtgaactggtagccgatacgatgacggtagataatgtacgttcggagttggaagctcttctatataataaggtatataggaataagatgttggaagagtatgatcgtataattcaaattttaggtccggcaggagcttcggaggcagcggcacgcaagatggtggccttactgaagaaataaacttttcacgctgtttttttgttctttcgggtaaataacctaaaccccggaaaatatgaaatattctttttcatcgatgttaggggcggtacttctttttagcggagtattcgccttttcagcttgtggcaatgacgaaagttatcccgatagtacagtaactatagctatggctacagtagaaaagcaacctcagtatgacgctccttattttatattggataatggagagaaattgtgggtggtacagaatgctgtaccttaccgggatttgaagacgggagagcgtatctttggaagttatacctttctggaagctggtgagagtggttttgcctatgatatccgtttgaatgactatgccatggtacctgttcaagatattatcggactgaatcctgataatatggatagtataggaaatatgaaagtgcagattaaagatatatggttttccaatgagtatatgaatgtgcgttttatgctgaattttcccaatccccaaaggcctattctcaatctggttgtcaatgagatgattcctttggtaaatgacgggtatgcgcatttggaactccgctataacaataatggcagccaaggacggttggtacctggtctggtttctttcaaattaggaagttactcaccggaaaacagtgaattaaaaggattaaaggtgctggtacgtcctgtaggcggtgaagaaaaaacatatatcttctcttacccgcttactgacaagagtacgcctgattttaatcttttggatctggcggaattaaaataaagaaactacatacaaatagactactgctgcagggatagcgaggattgcgctgtcgaaacgatcgagcattccaccatgtcctggcaaaatattacccgaatctttgatacctaaacggcgcttcaataaagattccgtcaaatcaccccaggtaccgaatattactactgttaatgctagtccaatccataccccggtggacatgaagggaaagaaatgagccagtatgaaggaggatatgatgcagaatacactgccaccgatagaaccttcccacgattttttaggggaaatacgctcgaacagtttgtgtttgccaaacagcatccccgtgcaataagcccccgtatcattcacccagttaaaaataaaaatagatagtgggagaatagcattgtattgtgaaatactcgctgtttcgtccgagtggaaagccaatacattcaacaaagcaaatggcagagcgatgtacatttggcttagcatggcgtatgcccagttgttcagaggattttcttttttcaaataaagttcgctgaccatcaggtagatgaataaagccagataaggaataaatatacctgtttgtgaaggatctattccaaaataaaaaaagcacaggaaaagaaaaattccgctgagaatacatatgcgtttatttacttgtattccttctacatgattgaccaaattacagaattcattgatagccaatgcgctgataatggcaaataggataccgaaagaaacagccccacccactatgcagcctatcagtactgcaacgaaaataattccggttatggcacgttgtaagaaattgcttttcacggtcgttagtcttaagtgattcaaaaatcaaaatagaagatctgttgtttaatcattctgagtgataatgaagaacccgtatctggattactacagactctttatatcattcagaatgacatgattatgattgacagatctttctacaatgttatgcttcttttttttctttttccttttcctcagaatctgaagatttcttctcttcaaaatcttcggttacttctactggttttactgtagcttctaaagccataatttcttctgaacgtgaggtccagggacgtttgccaaaaatgcgttccacgtcttcggcgaaaattacttctttttcaaccaacagacgggccagctcgttgtgaccatctttatgttcggacaatattgcctttgcccgatcatattgttcgttgatcattcttttcacttcttcgtcaatcagttcggctgtacgttcgctgtaaggcttgctgaaagagtattcatcgttgctgtaataacataagttgggtaacttttcactcattccggcgtaagcaatcattccatatgattgttttgtcacacgttccaaatcgttcatggcaccggttgaaatatgtccggtgaacagctcttcggctgcacgtccccctaaagtggcacacatttcatccagcatttgttctttggttgtgatctgccgttcttcgggcaaataccatgcggctcccaatgcgcgtccacggggaacaatggttaccttaatcaaaggattggcatgttccaaaaaccaagacagcgtagcgtgaccggcttcgtgtaaagcaatagtacgcttttcttcggcagtcatgattttggttttcttttccaaaccaccgataatacggtctacagcatctagaaaatcttgtttcccaaccgcattcttaccatggcgggcggcgatcagtgctgcttcattacatacattggcaatatctgccccactgaatcccggagtttgacgggcgagcaaatccagatcgacactttcatccagctttaagggcttcaaatgtactccaaatacttctttacgttcgtttaagtcgggtaagtcaacatgaatctggcggtcaaaacgaccagcacgcaataatgctttatccaatatatccgcacggttggtagcggccaaaatgatcacaccgctatttgaaccaaaaccatccatttctgtcaataattggtttaatgtattttcgcgttcatcatttccacccatgcttggatttttgccacgggcacgtcctactgcgtcaatttcatcaatgaatataatacaaggagctttctctttcgcctggcggaacaagtcacgtacacgggatgcacctactccaacgaacatttccacaaagtcggaacccgaaagcgaaaagaaaggtacatctgcttcaccggcaacagcttttgccagcaaagtcttaccggttcccggagggcctaccagtaaagcgcctttaggtatcttacctcccaactccgtgtatttctgaggttgtttcagaaactctacaatttcttccacttcttgtttagcttccgcttgtccggctacatctttaaaagtaatccggttagtcttgtctcctttttcgtatacctgagctttgcttttgcctacgttgaacggattggcgcctccggcccctgctccgccgctcatgcgacgcatggcaaacatccagataccgatcaatagtaaaaacggagcgatattccaaaataatgcgccgaagtagtcgcgtttcttttcataactgatagatccggtaaagtgaccttcttcctgtgccttttccatgaatttatccaatgactccatggaacctatttctacgttcaatgctgggttacgccctacttttttatagtcatttttaaatacatctttaacaaattccggtttaatgtacatttctaccgtattgtcatcgtatgcaattattttattggcatatcccttgtttatcatatctttaaactcggtatatgttatttgtttgtcaattcctccttcttgattggaaaaatagaggatggcaaaactcatggcaatgataacatacagccaactcaaattgaagcgtggcatgtttatctttggtctattattggtattttcactcattttgattctgtattggattagtctagatcaggaatttgggtcagtttggcatctgcccataaatgttccagattataaaaatttcttgtttccggcaaaaagacatgtaccagtacatcgctgtagtccattgcaacccattctgcgtttctcagtccgtctattcccgtaggcttgtcatctatttctttatgtacatattccttgactgagtcaacgatagctataacttgacttggggaattaccttgacagattacgaaatagctgcaaatggtatcatcaatggcggtgaggtccgctattacaatgtttttacctttcttttcttgaatgccttctgttattttttttactaaagtctctgcttcgttcattataatgttattaacaactgattattctaatatatgtatttacaacaatgcacaaagatacttggttttctcattctagcgaaaaaatgtgcattaaatatattcggtttttgttttttttagttagagaatctttttattgttatgttaagcctagagtgaagatacacggtcaagaaggataaggaaggctggaaaagaaagcaaatggagaaaaaagaatcttgattagaaaaaaaagcttcaaaaatttgtggattaaataaaaaaacgtatctttgcagcgtcaaaatcaaaacgggtgttttgataggaaaattgggatatggtgtaatggtaacacaacagattctggtcctgtttttccaggttcgaatcctggtatcccaacacataaaccacttattaaagacaaagttcttctaaaattgcaattttagaagaacttttttcattttgggctagctatcttaaaaatagaccaatcaaaattggtgtcaactctctatttttccgtaagactcatgaaaaaagcggggcagtccgaaaacaatgcaacgccaatccgggagtaattcggggttttgctttctctcaattgttctatttgtcttttttagtaggccatgaaaacacgcaggatgaaaaaggtgcaaaaaatcagtagtacgttagtaaaaaaagagtctaacgcatttgcattaaactctttttataactgtttttattcgtctttcattgattggtcaatcacctctattttttttaagatcaattctaggtctgccttgagtttttccactttacgattcatttccgtaaccaaactgctaccttttttggaagaactggtcaagaagcccaaattgttctcgtatgtttgaatttcattcttcatgttttcgtaagcacgaaccagtttttcgcgttcacgataaaggttgccttccttactgatgcttgatttaaagttacttaattttttctgtgatgcggaaagattcaacttgtcaaacaacttatcaatgacaccatgatattgcttgtataatttatctttctctttaaacggtacatgaccgatgctattccattctttcattaattctcgaatggtgtttccggcatcttcttccggtgtttcctgtgcgtcaattgtatttaacttttcaatgatcgcctttttctgaaccatgttttcctgttcaactgagcgttgtgaagaagtcgccttgttcttttgctcgaagaaataatcacatgcggcaatgaatcgtttccatacggcatccgaatactttttaggtacaggaccaattgttttccattccttttgtaatttgcttagaatatcagcagttgctttccagtctgtactttcttttagtgcttctgctttttcacataatgctttcttcttttccagattgcctgccatactttccttgatggacttgaagaactcggctttgcgtttgaaaaattcatcacaagcggcacggaaacgttcgaatatcttcacgttcattttttgaggtgcgtaaccaattgttttccatttggcttgcaaagcaatgatttcctgagttttgttttcccagtcttggaaggtagtgaacgtatcgtattccattgcttccacaatttcacagattacggtcttttcatccaagttacgttgctctttttcttttaaggcttcgaaatgttgctggtgacgacggtttacggctgtagaggcggttttgaaccgggtccagatatcttcgcgcaattcttttgcaacaggacccgtattccggaattcctgatgtaacttttgtaattgatggaaagcggaaatcacatcttcttcatcagccaatttctctgcggcttcacaaagatgagtctttatttcaaggttttttttaaaatcatactcacggaattcgttgttcaactttatcaagtcatagaacttttctgcatagtgctgataatttttccatagttcattgactttggcagccggcacctgttttatatcgttccattcctgttgcagtttcttgaattcattgtatgctttgttggcatcttcgggagattcggcaagttctttcaagcggtcgataatggcgagctttttcaccaggttatcttctttttctttatcttgttctgcttgtatggcgcttcttttctctttgatagagctcatgatatctttgaaacggttttcagcatcgtccggttggggaataaatgcctcaggagcacctccgccatcaataaatgccttacgggcggcttcttgctcagccttgtgcagcttgtagaagttctgtttcaataaatccaactcttgtttgtctgcattgcaggcgtcttcgttgatttcttttaaacgttcgatgacctcttctttcgtttgtttaggtacatacgtagcgttattttcttctgcagtagcggaagatgataccaaagtttcagatgtctgttccactggaacttcggttaaagggcggatagtttcattcgagtccatcgtatagatttttaaagtaagcgtttttgttataacaacaatttacaaattaaaagaaataaattagaacttcatactgtttttcccgatttttttaggaaaatccttaaaagtggagaaaataggagaatcaagggggataaatgcactgcagattacatagattcatacagattctcttttattgtgattctttgccggtttctgtgtgaatctgttttttctctgaatttcaatctatgtaatctgtagtgaaacgtgtcaggatagtaatacggtgatgcccatataaagcatcatacctataatgtcattggtgatggatatgaacggacctgtagcgatggccggatctatttttagtttttccagtgtcataggaaccagggtcccaaagatggaagcgaacatgactactgcaaacaggctgaatgaaaccgaataagtcacggtggcacttgccccgaaacggatgaaattatagatatataccagcatagaaataatagtagcattgattacggccactacagattcctttactatttgtttccaggtgttttgggcatccagcgagctgtttgccagtccttgtacgataagtgccgaggactgtgttcctacgttaccgcctgttccgccgataagggggatatagagggccatttcgggatgtgcggcaaaagtactgtcaaagttgcccagaatcatggagttgcctattccgcctatcatgccgatgagcagccagggcagacgggctgtagtctggcggaatacattatcgtctgtttccacgtcttgtgacaaacctgatgccagctggtagtcgcgttcagcctgttcacgtacttcgtccatcacatcgtctaccgtaatccgtcctaccaggcgtccgatactgtccactaccggaacggcgaccaggtcatatttttcaatggtttgtaccacttcgtctataggggtatctacatggacggatatcggttctttcctcatcacgtgcttcactttggatacggaagggctggtgatcattttcttcaacgggaacacaccgcgcagccgctggtcatcgtctactacatatacataatagatttcgtccatatcttccgcctggatgcgcatttccttcagacattcgggcatactccagttttcgtttacgattaccatttcggtacccatcaatccaccggcagtgtcttcgtcatatttcaacaaatcgacaatgtctccggcttgttctatgtcttcaatgtgtgagaggacttcttcttgtttgtcctcgtccatttcacggataatgtccacggcatcatccgaatccatgtagtcaacgaaccgtttggcgattgtttcagagggaaggatttccaggaattccttacgggcgtcttcgtccatttcgataaggacgtcggcggcagtctcattgtccagtaacaggtatatgaaccgtgcttcttccgcatccagttcattgcacagctctgctatgtcggcaggatgtagaccggcaagcaagtccttaagttgctctgagtctttttgctcgatcagctgctctactttttctaattcctctttattcatcctactcttccgttaatataataaataggtgttattctttcttgtttgttcctttccgggcgatatcgttactgtaaactatatccgttttatttttcagtgccgcttccactctgttagtcagttcgataaattctgatacagacaactgttccgggcgtttgttgaaaatcaggtctgcgctcaatggattctctttgtctaaaatggaagaaatagaatttctcaaagttttacgccgttggttgaatgttgtttttacaatgagcttgaacaatttttcattgcatcccagttccgtcgtttcattgcgtgtcatacggatgaccgcacttttcaccttgggaggcggattgaatacatgttcgtgtacggtgaacaggtattctactttgtaccaggcttgtatcaggatactgagaatgccgtatgtcttgcttccgggaccggcggcaatgcgttcggccacttctttttggatcattccggtacaacagggtatcaggtctttgtaatccagcattttaaagaatatctggctggatatattataagggtagttgccggtcagaacaaaaggtttcccgtcaaataatttttcgaggttcagtttcaaaaagtcgtcttcaatgatattatcttccaaggcaggaaagttctcacggagataggttacagattcatagtccagttccaccacttttaccgcacggtttttctgcataataaactgggttagtacccccatccccggtcctacttccaaaattggcaagtcagggcacacatctactgtatcggctatatcttttgcaatactgagatctttcaagaagtgttgtcctagaaatttttttggctttactaatcccattccgttatttttctatcgtttataaataggtttatttcgctaagatagtatctttgcatcgtgcaaaggtaaacattctaaattaatatacacagattttggaacgaactcgattaaaaaagattataaataaaggtttgcagattgcatttccgttatttttgggggctgcgatactgatatggatgtatcacggattcaatttttcccgggtatgggaggtcttggatggaggaatgaattattggtggatgttagtgtcattagtgtttggcgtgtttagtcatatttttcgtggctggcggtggaagcttacgctggctccgttgggcgagtatcccaaaacatccgattgtgtgtatgccatctttgtgtcttatgccgccaacttggttgttccccgtgtaggtgagatttcccgttgcggggtgttggctaaatatgatggtacatctttttccaaatcgctgggtacggtggttgcggaacggttgattgatacgctgtgtgtgtcgttgattacaggggtaactcttataatgcaggcaagagtgttcgatactttttttaaagaaaccggcacggataccacggttttggcacaggtctttacttcggggcatttctatattactatcatctgtgtgttggctgtattggtactggccttttttctgatcaggaatgtgacggtctttgccaaagtgaaaggcattctccataatgtgtgggtgggtgtgctgtctttgcgtcatgtaaagcggatgcctctgttcattctttataccgttggcatttggacttgctatttcctgcaattctatgtttccttcttttgtttcgatttttctgatgatttaggtgtgatggcaggattggtgatgtttgccgtaggtagcattgcggtagtggttccgactcctaatggggcgggtccgtggcattttgctgtcataacgatgatgatgctctatggagtaggaaaagaagatgcgggaatttttgccttattagtgcatggaatacaaacttttttattaattttgttgggtatatatggattagcggctttgccgttcacaaataaaactaagaagttatgagtacaattctctctctcgctccgcagaatgtgtggaagcatttctattcattgactcaggttccccgtccttcgggctacttgaagaaggttcaagagttcttgctgaactttggaaaaagtgtaggcgtagagtcattccaggacgaagccggtaatatcatttaccgcaagcctgccactccggggatggaaaaccgcaagaaggtgattcttcaggctcacatggacatggttcctcagaagaataacgatacagtgcatgattttgaaaatgatcctatcgagacttacattgacggagattgggtgaaagctaaaggcacgactttgggagccgatgatggtatgggtgttgccgctatcatggctatcatggaagacaagacgctgaaacatggtccgttggaagcactgattactgccgacgaagaaaccggtatgttcggtgcgttcggtttgaagccgggaacggtagacggtgatattctgttgaatctggattcggaagaagaaggagaattgtatatcggttgtgcaggcggtgaagacctgacagcagtgttggaatataaagaagtggaaacagatccggctgacattgctttgaaagttaccttgaaagggctgcgcggtggtcattccggattggaaataaatgaaggacgtgccaatgccaacaagctgatggctcgtttcatgaatcaggtgattacttacgatgaggcttgtctggtttcctggcaaggtggcaatatgcgtaatgccattcctcgtgaatgtgaagtggtcattacggttccggctgatgaagaagcggacgtactggactatgtgaaggagtgcgaagcattgtggaatgaagagtatcatgtacacgaaactccgatcagcttcaaggcagaacgtgtggaattgccgaagatgatggttcccgatgaaatcaaagataatctggtggatgccatttatgcttgtcagaatggggtgatgcgtatgattcctactattcccgataccgtggaaacctcttccaatctggctatcgtttctatcggtggtggcaaggcggagataaaaatcctggcccgcagttcacgcgattcaatgaaggattatctgaatactgcattggaaagctgtttctctatggcaggcatggaagtgacccgttcaggtggttattcaggctgggagcccaatgtggattctcctattctgaaagcgatgaaggagtcttatcaggcacaattcggtaaggaacctgctgtgaaagtgattcatgccggcttggaatgcggtatcatcggtgcggtagttcccggcttggatatgatttctttcggtcctaccttgcgttctcctcactcgccggatgaacgctgctttattccttctgtaggtaagttctatgacttcgtagtagctaccttggaaaatacgccggtaaaagaatagtctttaagatcttataaagatttcgggcgcggacgatagggatttcgtccgcgcctttctattaatactccactttgtcacttttctctgtccattgttggaatgcctttattgcctcttccgccaaaagaatttcggagggcagcttgcgtgctgaaggtttcaggcttaactcatcatagataaaagagtcatcaaaacctatattcttggcatccgtcttgttgtttgcataatacattttatccagtcgtgcccagtaaatggctcccaggcacatgggacacggctcacacgaagtataaatttcacacccactcaggttgaatgttcccagtttggttgccgccgcacggatggcgctgacttccgcatgggcggtagggtcgcattgagaagtgacacgattgactccggtagcgataatttctccgtccttggcgataacggctccgaaaggaccgccgccgtttgccacattctctatagaaagctcaatggctttccgcattaattcttctttcttcatagtggtttcatttctttttgtacagagcaaatatacgatatttccggctatatactgcgggagagggcttattttattcggaaactgccgcttcatgtgtacacttgtcggtttctgctaccattgaggtgattatcagtgcctccggggacattgccctgttttttgtttcagaagcttcagcctctccgcaaaagcccgtcaatagggcgaagcggctgaaggattgcctttggaaatttcttcagctcgattatggaagcttcagtttttggctgttcgggatgtgtctctgtgtaagttcattttttctagtgcttttatacctgttggaaatgatgttactattaggaagagtttgctttgtgccgtaatggctttattgcttcaccttagtgaagcagccgtttcacacaggtgacaacggatcttcaccagagtgggatggcgtgttcacctaggtgatggacagaaaatacaaacttatcctgatgaaagagaatatgtttccggttgtgtcagtttgcttatttaggggtgcgatacggtgacaaatgcctggatataggacttttgaagcattggggaaccagtctgtgcggagtatgcatactctcaaaggatgcggctgaaggatttttcttcgggctgaagctttttctggtgtaattcttcagccggaatgcccactggcaaagggtttgcggagaggctgaagcttttgaaggaattttcctttccttttttcttgtatcacaaatttgctgaatactcctggttttccgtaatgcgtcggcccgggctaatactttgcaccctttcgggtatattatacgaaagaaactaataaattatacccattagggtgtaattgtcgaagcttttgctatatttgtaccctaaagggtgtaattatgagtgattcattgtcattgtttgtaaaagaaatgcgtaagcggttcggacttacgcaagtagatttggcggctaaggcgggagtggggcttcgctttgtgcgcgagttggagcaaggaaagcagactttgcggatagacaaggtaaaccaggtgcttgccctcttcggacatgaagtaggggctgtgcccttaggaaaggagcatagcgcatgagaaggggaaaaatatacttgaatgatatctatgcagggttgttgacggaagatgagaatggtttcacctttgcctatgatgccggattcttgcgttccggcaaggcggaagccgtcagtctgacactgccactgacggacaaaccctatcacgacaccgtcttgttcccgttctttgacggcctgatacccgaaggatggttgctgaacattgccgaaaacagttggaagataaatcggcgcgaccgtatgtcgctgttgctggcctgttgcaaggattgcatcggggcagtaagtgtagtagaggatgaacctgataaaccggaaacatgatggaaaggtgtttgtattgttataaggaactgaaggaaggacaggtggactatcatccggcttgtgcccggaaacttttcggtactcgtcaggcgcctcaattgccttacgtgcggagtgaaataggcgaactggccaaacaggtagtgagggcacagactacgctgacgggcgtgcaggccaaattgtcgctcgatgtgaatcccggcggaaagaacgagccggaccgttttaccatcgtgggcttgtggggaaagttcattttgaagccccagactgatttttaccgggcattacctgagctggaggatttgaccatgcacatggcggaagcagccaaaatagcggtggttccccacgggttggtgcgttttgccgatggcgaattgggatacatcacccggcgcatagaccgtcgcccggatggtggaaagattgccatggaggacatgtgccagttgacggaacgtctcaccgaatacaaatataagggctcgtatgagcagatagccaagactatcaagaagtattctgcagtgccgcagcttgatctggtgaatttttgggaagtggtggtgttctcgtggattgtgggaaactcggatatgcacttgaagaacttttcattgtatgacacggggatgggctatagtctgacgcctgcatacgatttgctgtccacggttattgtcatgcccgaggatacggaggaattggcattgactcttaatgggaaaaaaaggaaaatatggagaagcgatttcgagaagtcgataatcgcatcgggggtcagtggcaaggtaatagagaacatcgcccggaaattccgacgttccatcattaaatggatggaactgatagatgtttccttcctgcccgaagacatgaagaaaccctataaaagactggtgctgcaacgtctgctttggctgcgctgaaagatctttccttttctgttttagttattttaattaaaacgtatgcagtctttaaacatctatttcgtttctttgttacagaagacttagtatgaactaaaagattgtagatatgaaaattcgttatttatctttgatagtgctactggtaatgagcgtatttgctcctatgcaggcacaaacctatgacaatttgtggaaagaactggaagtattggaacgaaaggatctgcccaagtcggttatttccgaagcaatgaaaatctacgataaagcaaaagcggaacagaatgtaccgcaaatgatgaaagcctatctcactgccatgcagtaccgttcccttttaactcccgatagcttgaaggtagatatgaatggtttggaacaatgggcttcccaaaccggcagtgtggaagacaaagctatattgtattccattctgggtgaaatgaccatgcctgccgacgtaaaaaagggattgggctatttgcaggcctctctcaaggataaagaccggttattacttatcccggtcgagaaattgaaacctatggtgaaggtgggggaagcaagtaaacggtattttcgtgataatctgtacaacttgttggcacgtcgtgccatacaaatcatgcagcagtacaggtggcaggcggctgctaaagcaaatcagacaaacagtctgcctgcggatatgacggatatggataagtttgttacttatcagtttgttcctgtctctgattgtgacttgacggcagccgtcatgcagacttatcagtccttgctgaaagtatatgatacggaaacggagcgtgagggttggttgctgaccgggatagatgcattgaattacctgtaccgcaatttttccggaaacttctcgaatgacgtatgccaacaggaactccggaagtggattcatacttatccggctgtgaaaacagtccctgaagcttatctggctttggcacaattcctacagtatcaaaataatcaggtagagcgcttgcggatagttcgtgaaggaatagccggatacccccgttacgaaggtatcaaccaactgaagaatatagaaaaggaaattctgaatgcaagcctttcactggaaatagctacggcttatcctggtgaacagcagtcggtgaaagtaaattataaaaaccttaccggcatcactttgcagttatataaggtgaatttacccgttacctctgccgtattgcagaacagaaccacccattttgaaagtaaatatgcccgtttgcaacgcgaggagcatttttctttgaaacctactacagattatttgaatatcgataccaccctgaccatacaggctcctcaagcgggaatttatttcttaaaggcagtgcccgatgggaagaagggcgtttcggacggaacattaatgaatgtcaccgctttaaagaccatttatcgtcctctgccggatggtacgttggaactggtggtggtaaatgcagtgagcggacagcctgtttctgaggcggaagtaaccatttatacggagaagggaggaggctattctcctcaacagacctatcaggcggataaacagggtactttgaaactggatttcctgaatagtaacaaatactggtataatgcacatacggcggctgataatgcgatgcccatcttgaatctttggaaaaacgattattactataaagagagcaagaaaaaagaagttttgcaattatttaccgaccgatccatttaccgtcccggtcaaaccgtatatgtatccggcttggcttatgaaatggaaaaggattctacgcgtgtgcttgcggataaaaaatatacggtatccctatatgatgcgaataataatgaaacaggaaaagtagaagtatggacgaatggttttggttcgttcagcggacaatttgttttgccctctccttgcctgaccggttattttagcttgcgtgcggccgatacttctgtcagttttaaggtagaagaatataaacgtcccacctttgatgtcacgtttgaacccgtgaaagtggagtatcaagtgggtgactctatagaagtggcgggtatggcaaagacttttgccggtgcgcctgtgcagaatgccagggtacactataatatatcccgttcctatgcttggttctggcggtttatgggcagaggttcagcccgttgggagggagaggcaatgaccgatgcggatggtaagttcaccgttccggtgcattttgaaatagactcggacaggagagaatctccgttgtggtattatacgtacaacatacaggcggatgtgacggatggtgcaggtgagacacagcaagctaatttgtcattgcctttaggaagcacttcaatggtgctgaatatggataatctgcccgataattgggttaaagaaaagaagctggaaataaaactgacagccatgaatctttcgggtgagccggtagatactccggttacttatcaggtagtcgagatggagaagcagaaagacggtcaggaaaaagaaggcagaaaggtattgaccggtacggtggaagctaacaaaagttttattcctgaggctatttatgccctgccttccggtaattatcgtttgaagctttcggctaaggatacacaaggcagagagtgtacggcatctaagaatttccttttgttctcattgaacgacaagcgtccgcctttcgtgataacggattggttctatcaggatggtctggaatttgatgcagcatctccagctactatatatataggtagcagcgaaaagaatgtctatctgctttatgatgtgtttgcaggcaataagcgcttggaaagcaaacgtatacagctttcggactcggtgatcagtttccgcttcccttataagaaggaatatggtgacggcattctggtaagtatggcatttgtgaaagacggcagactttacagtcataatgcacggattatgaaaccggcccctgagaagaagttgcagctgaaatggactacgttccgtgacaaactccgtccgggacagcaagaggaatggaaactgacggtactttatccggatggacgtccggctgaggctgaaatgctggctaccatgtatgatgcttctctggataaaatctatagtgcacataagctggactttggagtggactttcattatgtggttcctttgacttattggaatacatcctatatgcggaatgcttatttgtatgttgatttcccgttgaagaggttccgtgcggttcctttggaatatagtgaattgatcattccatctacaggaagaatggaggctgtggtggtaggttacggaggcagtcctcgtgccactcttacaggagctttgaagattagaggcaggagtgccgcaaatgctgtgatgaaccaggaggctgttactgatatggtgctccaggaagaaatggtagagacgtctgtacaggaaaaggcagaaatgggcagttctgaagaactggcagaaacaggtgatatacagatacgtgaaaactttgcggaaacggcattcttttatccacagctccgcaccaatgaaacaggtgaagtcagtatttcctttgtattgcccgagagccttacccgatggaagtttatgggcttggcacatacccggaatgtggattatggaaaaatagaagctaccgctactgccagcaaggaatttatgcttcaacctaatatgccccgttttgtccgcgtgggagataaagcgaatattgccgcttcactgatgaatctgtcggacaagggggtgaaagggactgtccgcatggaattgtttaatccggaaacagaaaaggtattctattcacaaaaacagaagttcgatatgaagggaggagaaaccgggcatgtgaactttgcttttgaagtgagtgacaaatatgcggtaatggcatgccggatggtagcggatggagataccttcagtgatggagaacagcgttacattcccgttctgacagacaaacagtgggtaacggaaaccgttcctctgaacgtgaatggggaaggtatgcatactttctctttggaaaatctgtttaacaagcatagcaaaacggcttccgaacaacggttgaccgtagaatttactgcccatccggcttggtatgccgtgcaggctttgcctgtagtggctaatcctcagaatgaagatgctctttcctgggctaccgcttattatgcccattcattggctgcatgtatagtcaaagaaaatccccgtatcaagcaagtctttgatagctggaaggctcaaggtggtacaaaggagacttttatgagcaatctgcaaaagaatcaggaactgaaaaatatcctgctggctgaaactccctggctgacagaagctaccaatgaagccgaacaaaaacagcgtatcgccactttgtttgacctgaatacaatgaacagcggactggcagtttctgtagagaaactgagagaattgcaaaatggagatggcgcatggagttggtataaaggtatgcaaggcagccgctatgtaaccactcaggtaatggaaatgcttgtccggctgaatgcattgactcctcaggatgctgacagccggatgcagcctatgattcaaaaagggttcgagtatttaggcaagcaggctgccgaagagtataagtctatgaaagaagctgaaaagaaaggggctgtcggtatccgtccgtcagaacaggttctcaggtatttgtatatctgcgctttggatggcaaggctccggttgatgaaaaggtgaaccggtatttcatagacaagttgtccggtgagggaaaagaactgacgatttatggaaaggcgttgggagctatcatcttgcagcaagccggtaaggtggcagaggccaagttgtttatgcagtcattgatggagtattctgttgtgacggatgaaatggggcgttactttgatactcctaaagcccgatattcatggttcagttataaaattccgactgaagtggctgctatggaagctatacagcgtataacaaaagatacgaaagctattgatgaaatgaaacgctggctgttgaagcagaaacagacacagacttgggaaacgccgatagctacggctgatgcggtgtatgtattgatggctacaggaacttcggatttattggcaaatacaggaagagtagagattactttaggtaaagaagtgatccggacttcggcagatgatgccatcggttatatcaagaagacgatgtccggtgatgtgatgaatatcaagaaaataagggtggataaagaaggagccggaatgggttggggagccgtttatgcccaatatctggaaagtatggatcaaattagcgggcagggaaacggattgtctgtcagccgtcaattatataaaggggatgaggctttgaatgaatcagctccgttaaaggttggcgataagattaccgttcgcctgactgtaaaggctgaccgtgatatggattttgttcagatcaaggatgaccgtgcagcttgtatggaaccgttacaggcagtttcgggatttcgttggagcaacgggctgggatattatcaggctaccaaagatgcttcgacccagttctttatcgatcagatgagaaaaggaacttatgtgatagagtatcaggtgtatgtgaaccggacaggagaatatcaggctggaattgcaactgttcagtctgcttatgctccggaattcggagggcatacgggaggatatcgggtgatggtggaatagagaaacaggatgtctggaattagttgtgtgatttcataaaaagtaagttagcttgctaacttactttttttcttatgcttctgccgtccacccattctaatcttatttcaaaaccatcttcagccgtgccataaaaatagcggcctgaaacggatggatattcaattataaatgtataaccatctgaataatatagatataaccaaccgttttgaatttcccagtcaaacttatataccctataaagttcatcatcatagtaacagcgttcttccgtacctacaccatgatccgggaaagtacctgaggtgaatgtaatataactgtaaagccgttctccgtatgggtcctcaaatcccatttcgccccaccaagtcttaccgtataatcctgaaatatcaaatcctctttcttcatcgctttcacatgaagaaaaacttatcattgtaatcaatgcaatggcaatgaaccagtaatgttttactattttcataatttatctgatttttaatgcgggacaaagataaaggttattcataagataaaataaattataggctgaaaaaatgggtaaaggatgttttttgtctatctttgctatctaaaaagcataaaataattgtatgaaacatattatactgatagtaagtttgttaatgggagtgactttgggagtacaggcacaacccaaagcattatttgataagacaacgcatgaatttggaactattttatggaaaaatccggtgacggctacctttaaaatcactaataaaggagataaacctttagtgatatctaatgtgacaacttcttgtggctgcacggttgctgattggaccaaagaaccgattgccccgggaaagaccgggagtgtcagttctacttttgacgccaaagccatcggacgttttcagaagagcgtaggcatttattgcaatgcctccaataaacctatctatctggctattcggggagaagtgactgccgatcctaaaaactatactttcactcatccttttcagattggagctatccgtttgaataaggaggaaatagaatttgaagatgctaataaaggggataaaccaactatggaactgttggttgccaatacgtcagataggttatacacccctgtgttgatgcatttgcctccttacctcagtgctgttgccattccggaaaaactgggaagaggacgtacaggtaaaatcaagataactcttgatacggaaaagttacctaaactgggtttgacaacggcgtctgtttatctttcccgtttcctgggagataaggtgggagaagaaaatgaaattccggtttctgccgtattgttgccggatttctcacatatcagtcagcaggaacgcttgaatccgcctgccattcatctttctgccgaagagttgcagatgggagaactggaaagtgatgaaaagaaagcacatacgattattattaaaaatgtaggaaaatctaatctggaaattcgtgatttgcaggtgttcaattctgctttgggggtccagttgaagaaacgtgtcttgaaaccgggtgcgtctaccaagttgaagattactgctttcggtcaaaatttgaagaaagtaaagggtactccgcgtgtcctgatgataaccaatgatcctaacaatccgaagataattattaaagtaaaagtaacctcaaaaaaatagctatggaacatcctgaaaatagtgaagaatataagggattgacagtgaacaaaggtattgagcaaccatctattgtgaatccttatttgaaactacgtaaaaaacctcgtcgtcgtgagttttccgtaggtgaatatgtagaaggcatcgtaaaaggtgatgtgaccgtattgagtcaggcggttactttagtggagagtgtaaaaccggaacatcaggctattgcccaggaagtgatagagaagtgtctgccttattccggaaattctatgcgaatcggtatcagtggtgtgcccggtgccggcaagagtacatctattgatgtatttggattgcatgtgcttgagaagggaggaaaattagctgttttagctattgatcccagtagtgagcgttctaaaggcagtattttgggagataagacccgcatggagaaactatctgtccatccgaagtcttttatacggcctagtccgtcagcaggttcgttgggaggagtagctcgtaagactcgtgaaacgatcatactttgtgaggcggcgggctttgataagatttttgttgaaacggttggagtagggcagagcgaaacagcagtgcattctatggtggatttctttttgctgatccaactggccggtactggtgatgaattgcaggggattaagagaggtatcatggaaatggcggatggaatcgttatcaataaagctgacggcagcaatattgagaaagcaaaactggctgccagtcatttccgtaatgctttacatttgtttcctgctcctgattcgggctggagtcctaaagtaatgacgtattccggcttttatggtattggaattaaagaaatctgggatatgatctatgaatacttcgcttttgtgaaagcgaatgggtattttgaatatcgcagaaatgaacaggctaagtattggatgtatgagtctatcaacgagcatttgcgtgatagtttctataataatgaaaagataatttctatgttggctgcaaaagaggaagaggtgctgaatggcaaactgacttcgtttgttgctgccaaaaagttattggatgcttatttctcaaccttgaaataaggttttcctactactacaggtaacataaaaaacgcagatttaatgaataattataatctgcgttttttgtgtacctgtggtggataaaaattagatagaaagttcatgaagtacgttcaccaattctctgtctataggcttgtcgttctttatagctttagcgaaaggtacataaacaatcttatcatcatcaataccaatcattacattacgttgtccttccaatagtgcttggatgctagccactcccatacggctggcaataattcggtcatgcgctgtggggcgtccgccacgttgcaaatgtcctaatatcgttacacgcacatcgtattgcggatattcgttcttcacacgttcggcatagtgcattgcacccccggtcagttcgctttcggctactaatacgatactactgctcttggatttgcggaaaccatgttcgatgaattcttccaattggtcaacttctgtgctgaattccggaataatagctgcttctgcacctgcggcaatagcaccgttcaatgccaagaagcctgcatcacgtcccattacttcaacaaaaaataaacgttcgtgagaagttgccgtatcacggattttatctactgcatctaaaattgtgttcaaagctgtatcatagccgatggtggtgtcggttccatacaggtcgttgtcaatcgttccgggcagaccgatacaaggaacatcaaattcttgtgcgaaaatacgtgcaccagtcaaagaaccatcaccacctataatgactaaagcgtcgatttcatgcttcttcatgttttcgtaagcttgtgcccgtccttcgggtgtcgtgaattctttgcaacgggcggtcttcagaatggtacctcccatttgtatgatgttactaacattttggcttttgaattcctgaatttcatctgttaccaatcctttgtatcctctataaatgccatatactttcaagccgttatagatggcagaacgtgtgactgcacgaatggcagcgttcattcccggagcatctcctccagaggttaaaataccaatgcttttaatcgttcccataaatacccattttaatatttttatgtcgcaaagttaacaaattatcagttggacaacgataattttctattttttattggtctatttttcgtttaagattgcttttttacattcttccatcaaccatttgggggtggaagttgctccacaaatgccgatggaacggacgttctcgagcaagttccggtctatttcttccggctggtcaatgaggtatgaattcggattaatctttttgcattcttgatataagatctttccgtttgaactttttcgtccgcagacaaaaaagatcagatcatgcgctgctgcaaatttgcggatgttaggcatccggttggccacttgccggcagattgtgtcgtaatattcaaaagtggcatcgggtgaaatgtgttccttgatatattctatgatttgccagaattcttccagagatttggttgtctgggagtacaagcgtatgtctttagtgaagtctaaatgagcagcttcagcaggtgtttctatgacaattgcttttccatgagtttggcctaccagccccagtacttcggcatggccgtttttgccataaatcacgatttgtgtgtcttgacttgccggaacattatcatactcctgtttgatgcgcttttgaagacgtaatactactggacaggtggcgtcaatgatctcgatgttgttggtacgggctatagcgtatgtttcaggaggttctccatgtgcacgtaacagtactttggcatcgtgtaattgggcaaactcttcgtggttgattgtgataagccccattttttttagtcgttcacattcctgtccgttgtgcacaatgtctcccaggcaataaagagtgtttccttttgccagttcttcttctgctttacggatggccgtagtgactccaaagcagaacccagatccttcgtctatctctatgttaaccatttatagctgcttgaaatttttcggtcagccactctttctgttcggcaatgctcatgtggctgttgtctaacaagatagcgtcatccgcttgtcgtaacggaccgacttcacgggtttggtctatacggtcacgttcttccacattttccaggattttttcataagaggcctcttgccctttactcctcaattcatcataacggcgctgtgcacgtatggcagccgaggcggttacaaatattttcagttcggcatcggggaaaacaacggttccaatgtcccttccgtccatgacaattcctttggcctttcccatttcctgttgttgttttaccaaagcctcacgtacaaagcccaaggcggcgatagggcttacatgagaagaaacctccatgctgcggatggcatcctctacatttgtatcgttcagaaaagtcatgggacgttgtgtttccggattcaaccggaatgaaatatgtatatcgggcattgctgtttttaacgcttcggtgtcgatacctttttccgaaaagaaccctttctgtagactatataatgtaacagcacgatacatggcaccgctatcaatatagatatatcctatttcacgtgccaagtctttggccatagtgctttttccacatgatgaataaccgtcaatggcaatagttattttcttcatatataattaatgtataggtgactattaaaaacgcttcaaagatagataaaagttgggtgtatgtctatgaaatcggatgaaaataaaatgaattagcatatttttcatgtgaaaatactttttatttaaaagatttgtgttacatttgccctcagtgagaaacacttaatttttaaaacacaatttatggaagttaaaaaatcgcctaaagcagatctcgaaggtaaaaagagtacctggctgcttatcggttatgtgtttatccttgctctcatgtttgtagctttcgaatggactgatcgcgacaagcaagtgactacggatacaggtataactgatgtcgtatttgaagaagaaattatccctattacggaacaggaacaaaaacaagctcctcctcctcccgaagctcctaaagtagaagaagtgcttcagatcgttgaaaacgatgctaaagtagaagaaacgactattcaggcttcagaagaaaccggtcaggcagtagaagttaaatacgttccggttgaagttgaagaagaagaacccgaagaacaacaaattttccaagtagtagaagaaatgcctgaattccctgggggtatggctgaatgtttgaaattcttaggtaagaatattaaatatcccactatttctcaggaaaatggtgtacaaggtaaggttatcgttcagtttgtcgttaataaggacggttctatcgttgacccggtggttgtacgtagtgtagacccctacttggataaggaagctctccgcgtaatcaagaccatgccgaaatggaaacctggaaaacaacgtggtaaggctgtacgtgtgaaatatacagtgcctgtaactttcaaattacagtaataaaaatacttcaatatcttaattgagaggctgctttgaggcagcctctttttctaataatcccttaattaaaacaatcttatggctttttctgcagaacaattattagataaggtaaatacctaccttgctacaatgccctatatgcgtgaaccgaaagggttatatgctcctatagaatatgtcctttcattaggtggcaaacgtatacgtcctgtcttgatgttgctgtcttatcagctttataaagaaaatgtggatgatattttatcacaggcggcaggtatagaaacttatcataattatacattgttgcatgatgatttgatggatcgtgcggatatgcgcagaaataagcctacagtgcataaggtttgggatgaaaatacggctattctttcaggagacgccatgttggtattggcttatcggctgatgaataattgtccggatagctatttaaagcaagtaatggatattttcagtcagacagctttggaaatttgtgaggggcagcagtgggatatggaatttgagacacgtagtgatgttaccgtatctgaatatattgagatgattcgtttgaagacatcggtacttttgtctgccgctttaaaaattggtgcggtgttaggggatgcttcggaagaggatgcacaaaaattatacgatttcggtattaaaatgggattagcatttcaattacaggatgattttctggatgtatatgggaatccgaaagtatttggaaagaatattggaggggatatcttgtgtaataaaaaaacgtttatgctgattaatgccttaactttggccgacggacatcaacggaaagaattggaaaaatggatttcatctactgatttctatccggaggaaaagataaaggctgtgacagaactttatgataagattggcatcggcaggatttgtgaagagaaaattaatgcttattatgctgaaggactttctttattggaaagtatagctatgccttccgggaaaaaagaagagttgaaatcttttgtttgtcatttaatgaataggaaagtgtgatatgattgatacacattctcatttgtttgccgaagaatttacggaagatttgccggcggtgatagaacgtgccaaggctgctggagtttctaaagttctcatgcctaatattgatgatactactatagaggcgatgctgagtgtttgcacggcatatcagggatattgttttccaatgatcggatttcatcctacttctgttgatgcagattcattgttccgtattcatgaaatgaaaaaaatattctccgatgggcatccttttattgctataggggaggtggggatggatttgtattgggataaaacctatttgaaagaacagcagaaagcattggatatacaggttcagtgggcattagaatatcatttgcctttggtgctgcattgtcgtgaagcttttcctgagttgtttgaagtgatggagccttacaaaacgactgagttaagtggggtcttccatagttttacgggaactttagaagaggctgagaaggtgttggagtattcgcgttttgtctttggaataaatggagttgttacattcaagaagagtagtttgcccgaaattttgacgcatctgcctttggatagaattgtccttgaaacagactctccttatttggctccagtgccttttaggggaagacggaacgagtcttcttatataaagaatgtagctatgaaacttgctgaaatctatgctgtggattttgaatacatagacagaatcacgaccaataatgctttaaaagtgttcaaaatggctgaataagtttttaaagtttattaattttgatgagtaattccaataatgacagggttaattctacgtaagacgaaaaaaaagaatacatttgtagctgaaatcgcttgcaattcccgattttctttgtaatttgcacccgatttaaaaaaagatagtattgtgtagcccgaaataaggagagatgctcgagtggttgaagaggcacgcctggaaagcgtgtaaacgccaaaagtgtttcgcgggttcgaatcccgctctctccgctgttgttatggaaaacgtaaaagcaggaaaacaattaaaacaaataaataacaattaattaattaatcttaaaaaattagacacacaatgaaaaagttatttgcaattcttgcagtgatgggagtccttactttaggatcagttcagcctattatggctcaagacgcagctccggctcaaacagaacagactactgaagcagcagtggttgaagaaggtggtggtcttcacaaagagttaaaaactaagttcatcgaaggtgatgctggttttatgtctctggtagcaatagcactagttttaggtttggctttctgcattgaacgtattatttatttgagcttggcagaagttaatacaaagaagttgatgactagcatcgaggctgctttggaaaaaggtgatgtagaagctgcaaaaaccgtatgtcgtaatactcgcggtcctgttgcttctatttgttatcagggtttaatgagaattgacgatggtgttgatgttgttgaacgttctgttgtttcttacggtggtgttcaggctggttatcttgaaaaaggatgttcttggattacattgtttattgccatggctccgtctttgggattcttgggtactgtaatcggtatggttatggcgttcgataaaatccagcaggcaggtgatatttctccgacagttgtagcaggtggtatgaaagtggctttgattactactatctttggtttggttgtagcattgattctgcaggtattctataactacatcctttctaaaattgaagctttgacaagcgctatggaagattcttctattactttgcttgacatgatcatgaagtacaacttgaaatacaaaaaataattaggacaatggctaaattatcatataaaatgtcctactatgctttatatgtctgctttgccgttattttggtagtattgggcatgttcttcttggtaggatataataatccggtgggagatatgaatgctcccgaacacactgaaacattgatatacttaatgtatgcattgtttggtgtaactgttggcttgacggttattgcagcaattgcacagtttggcgcagctttaaaagataatccgatgggagctataaaatctttacttggtctcgttttgttggttgctgtagtattaatatcttatgctatgggatctgatgcaacgattacagctaatgaagctccttatacggatactttctggttgaagataacagatatgtttatctattcaatttatttcttactgggtattgctgctttagcaactttggtaaatatgacaggtatctttaagaaataatattatctcattgatatttaacaattaaaaaacaaagtaagtaaaatggcaagaaagaaaagagccgtacctggaattaactccagttcaacagctgatattgcctttatgttgcttattttcttcctgattacaacatcaatggatactgaccgtggtttggcgagacgtcttccgcctcctcccgaaaacaaggatcagaaacaagatgatattattgtaaaggaacgtaatgtactccaggttcgtttgaacaaagatgaccaactgatgtgtggtcaggactacattgacattaagcaattaaaagaaaaggcaaaagaatttatagtcaatccgtatgatgatgaaaaattgcctgaaaagcatagaaagaatattcctttgctgggtgattgtatgattacggaaaagcatgtaatctctgttcagaatgacgttggtactagctataaagcatatattgacgtacagaatgaattggttgctgcttataatgagttacgagacgagctaggaaaggctaaattcggcaagacttacgctcaatgtgatgaagatgagcaaaaagcaattcgtgaatattatccgcagaagatttctgaagctgaacctaaaaagtatggaggtaagtaatgggaaaatttaataaaacaggtaaacgtggaatgcctgagttgaatacctcttcattgcctgaccttatctttaccatgttgttcttctttatgattgtgacaaccatgcgtgaggttacattgaaggttcaatttcaggttcctcaaggaacagagttggaaaaattggaaaagaagtctttggtttcctttatctatataggtaagccgttgccggagttccaaaagaaaatgggtgctgaaagccgtattcagttgaacgataagtttgctgaagtatctgaagttcaggactacattactcaagagcgtttgaatatgaaagaagaagatcagccgtttatgaccgtttctttgaaagttgataaggacacaagaatgggtatcgtaaccgatgttaaacaggcacttcgtcaggcttacgctttgaaaattaactattcagctactcaacgtcagtaatagttatataagcatagataaaaaaggaagctgttaaaaacagcttccttttttatgtcttctattctatttatttgttatgaacggatttaatctgctacctatggtatagtaatagtatgtacaatggaccttttgaggataaactcctgcgcgagtcagcattatagtaattgaagaaagatgaagaatgaatgttcagatttcttgtccgtaaacttctttataaagagtctttttaactttctcaaaatcactttccatatctatatccccataggtcattaagagcattggtagaccgttatctcccttacggtagggaggttgcatatagggctttttatgcaaagtgaattccaaacgtttatagaagtgaatacggcgtgtgctcatttcatcattaggctcctctacttccaatacaattggaccttttaattgtttttttatcatttccagtacacgttttccataaccgccgtttctgagactgggatcaatagcaaaatgttcgatatagtaaaaatctcccattgtccaataactgatcataccaatgctgttaccgttttctaaaataatgttgttacagaaccggagattattatcagaatattctctctgttgtacagtatcacgacgttcttcttgagggaatgccgtatgcattaatttttctacaaaggtatagtttacctcatcttgtgtttttacttgtttaatttcaatcattttatctgtctttgtttagtcttaagtataaacctattttgcggtataaaagtttattagtctttctaatgcacgttggcataccgggcagaatgcaggtgcttcgtttatcttcattctgcattcggtagtagggcgataaagtcctttttgcgtatagcctgctccttcatagactcctactttggtgtataagtcggcattttctgtagctaccggagtaggtatggcagtacctttcggaatcatatctttccatttactgtcgaaatcaattaatgtggtgatattcggttcccaaggttccacttcatatggatattgcgggcttggagcttcggtatatgcatattcatctgctaatcctccaaaactatggccgaattcatgaactacaactggttgaaaatccggatggtgagctgtggtcagtgtatatgagttatagatgccacctcctccataggtgtctgtattggctagaataatgatatgctcgtaaggaattccagccaaccaattatgaatactttttacccgactggtagtgagataccggtcagaatagaaagtgttgaaatgtgaacttacagccgtagatttccatttgccttgtcccggtatgctgactccgctgtcttccgaagggcttgctacagcaacaatattaaatttctccttcagtttcttgaaaggttcatgactgaacagggcgtcacatgccgtctgggcatctttataaaatatatccatctctttttctgtatatccttctgccatgattgctacatcgatacaatctgcggtatttccgctttgcagaagatagcgatggggggtaatatggtttgttccccgttgatggattaaaatatcattggggactatttcatgtgtgagtgaggcatttactttatgatatacatcttttaaagatatggtcactattgcttcctttttgggataaggcaaaagaaaagaattctcgaatcctttttttatcctatttgcttcttcttcgcttacccattcttggaaaaggcttgagaatgatgttcgataaatagtttttcctgttgccttatctttcatcgtgatttcaccgttgccagccaagggaagctctgctagatgatgcttgcgtccagcccatttcggaagacttgacagttcgtccaaatatatttcttgtttagtggcattaccagtaaaaatataatctactcgaagcgttttgtcttcgaaatagtcattaaaattttgtgcgtttacagctacgctgaataaactccataaaataaaaataaatgtctttttcatcgtttgcgcattttctacaaagatagaatattctattaaattattggtatttatacaataaaagttatgaatcgcacgaatattgtcgagaaaagtcatatctttgcagaaaattaaactaaaaagaatgggacatcatcaattagacagtttggatgagcagatcttaaggttgatagccagcaatgctcgtattccgtttctggaagtagcccgtgcttgcaatgtatccggtgctgccattcatcagcgtattcagaagctaaccaatttggggattcttaaaggatctgaatatgtcattgatccagaaaagatcggatatgaaacatgtgcatatattggtctttatctgaaagatccggaacaatttgattcagtgacagaggctttaaaaggtattcctgaagtcgtagaatgtcatttcactacgggacaatatgatatgtttatcaagatttatgcaaagaacaatcatcatttgcttagcataatccatgataagttacaaccattgggcttggctcgttcagaaactattatatcatttaatgaggctattaagagacaaatgcctattctcgatttagctgatgaagattaattgttactttatgcggctataattaataaaactatacgggtagagatgtttttcatctgtcgggtgatcttctctacctgtttctttccattcctctttctttatttcgggaaaataagcatcagcttccttggatgtgtcatcaataaatgtgatatataattgtctggctatatgcattgcctctttatacaagctggcaccgcctataataaatatttcttcttcctctttgcagtgggataaagcgatctctaatgaggggaaacattcagccccggcgaaggctgctccttcccggcggcttaatacaatattccgacgattgggaagtgctccttttggaagtgattcaaaggttttgcgccccatgataatagtatgtccggttgttaaggctttaaaacgtttcaaatcgttgggaagccagtataataatttattttcaaatccaatgccgtggttgcgtgctattgctactataattgaaatattcatagtgatgagtgattagtggtgaatgtttagtgatattagtggtaagtgatgaataaccttgcgtagcttattcaccataactactaaacagatactttacctgcaatgtgtggccatggatcataattcaccaattcaaaatcttcatatttaaaactgaatatatcctttatgtccggattgattttcatttgaggtaggggacgaggttcacggctcaattgaagttttacttgttccaagtggttggtatagatatgtgtgtcacctagtgtatgaacaaaatcgccggtttgtaatccggtaacttgtgctaccatttgtagcaacaatgcgtaggaggcgatattaaaaggtactcctaggaatgtatctgcgctgcgttggtaaagttgtaggcttaaacgtccgttggcaacgtagaattgaaaaaaagcatggcaaggaggaagattcatattgtttaaatcggctacattccatgcgctgacaatgatgcgtcgtgaatccggattatgtttgatggtttctattgcttcggaaatctggtcaataaagcctccattgtaatctggccaggaacgccattggtaaccgtagatatgtcccaaatcgccgtttgcatcggcccattcattccagatgcgtactccgttgtcttgcaggtattttatattggtgtcaccttgcaaaaaccataaaagttcgtggatgatagattttaaatgtagttttttagttgtgaccaaggggaagccttcttccaaattgaagcgcatttgatgaccaaatatactaatggttcctgttccggtacggtcctctttgtgaacgccttcggttaagatacggtttaacagatctaaatattgtttcatgctcggaaaatcattttatggattgcaaaagtacataaaatctttctttttccgagcatgagaatgagtctatttcgttttttaccattttaaactgcatacacgttgtacaccgatgatgataagaaccactgtggcgatgatcagtgattggaaattagtatcactcatcaaataataagtttgggaagcgactatgtcactgattgtctggcatagaatttcaaagccattgaaaatatagaataatgcacagcagataatggcgcaagttacactgagtatatccgataaccacttggcttgttgggggaggcggcggataacctggcgtgaaaatccattgtcctcaatttcatgtttgtaggcaagcatgaaattcttaattaatttatcatcgttttccatcataaccattctgttttaagaaagttgtcaattttgtttttccgcgtgataaatgggacttgattgttcctgcaggcattcctgtaatcactgcgattttttctatcggaagatcttccataaaaaataaggtgatgcaggttcgctccacctcttttaattggctcaatccccgatatatgtccatgtgttcacctacttgcctttgttctgtttggtaaacagcatctatttcccaagtttccagtccggacgtttcttttttgctgcgaatatagtcataaaatatattataagcaatacggtaaagccatgtggaaaaactggacaaatttttaaatgaagccaagttggtgtatgcttttataaaagtttcctgtgccaagtcatcgctgagttctgtatctcctaatgtttggtgcaggaaaaaacgcctgatgggcgattggtactttttgaccaaagtatcaaacgcccgggtgtttttaaagaccaccacttgtgctaccaacgctatgtcgttgatttggctcatttttattcttcgttgtggggagtatctatattgttctttatgttttgtgtttctttggcctcttcgttacgttccagttcaatattttcaattttcattgatttggctccgttttcatcctggtttattcgggtaggagggaaaggatcatcttttttctttttgtgtggagtggtagtataagctatcaatacttgtcccaaccccatacagaaaataaggaatccgattgctgccaatccttcttcttctgtcaacacccaaaggaatactcccagaccaatgcctaagaatatattcttgatcccctttgtcattacagcatttccttgttcttcggggtcattgaacagttcggtcggaatggttcgtcctgctgccagagcctctgcagccagtttgtatttggcttgtttgttcttgtacctgaaccaaagtacaatagctacaataaagaaagggagtccacaacagatgatgagtgcgacaattgctaccgaagtaggaggaccgctattccagtcaccgaaatccgaactaatgttatgcatggcagcattctgatcctcatctacatcttgcaggtcgcttataacgactgtatccatccgggtgctgtcaagggcggaaggtactaatttgattgttttggcatgggttgcgaagcaagtccctatgagtaaggccaaaataaaaagtaactgtttcatgtttttatatctttattattgttttctgctagttagacggaacgaattaggaaataggttgcaaatagacagaaaattttcagataatcccaaaatatcatcgtatttttgtagtataaaaaggaagaaatatgaaattaccatcagaatttgaagcaagaaccctggaatggatgggggaagaaacttatcgtgcgttggaagctgctttacagacagagcctcctgtcagtatccgtgtcaatcgtacgaagtggagtggggaagttacaggagaaccggtactttgggcatccgcaggggtctatttatcgcaacgaccgacttttacattcgatccgttgtttcatgctggttgctattatgtgcaagaagcgtcttccatgtttgtggaacaggtattacgcacttatattaccgggcctgtggtgatgctcgatttatgtgctgctcccggtggcaagtctactcatgtgcgttcagttcttcccgtaggtagtttgttggtggctaatgaggtgatgcgtaaccgttctcaggtattggctgaaaatttgataaagtggggaaatgtagaagttgtggtgacgaacaacgatccggccgatttcacttctttgacagaggtgtttgatgttgtcttggcggatgtgccttgttccggtgaggggatgttccgtaaagatcctgtggctgtagaggaatggagtacggacaatgtgcaggtttgttggcaacgtcagcgtaggattttagcggatatatggccggctttgaaacccggtggcctgctgatttatagtacctgcacttataatagggaagaagatgagaaaaatgtggcttggattgctgatgaattgggggcggagatactgaaagtgccagtggtatcggaatgggggataatcggaaatttggcgggacagaattttcctgtttatcgttttttgcctcatagagtaaaaggagaaggatttttcttggctgtattgaggaagagtgccgccatttctcatgctgttccttgcatttgctgtcgggatgacaaggagaaaataacgaaaaagaagaggaaaggagaaaaagggaatttgtctcaggctgctccttttcccaaagaagtaaaaagttggttaaagcaggcagaggatttccggtttgaggtaagaggtacgaaggtgatagcattccccaatgttcatctttcggaatatgacctgttccgacaggaattaaaagttgttcatgcgggcgttactataggcgagttgaaaggaaaagacgtgataccggatcattcgttggcaatgagcacacagctgaatcatgatggtttctcttgttttgaattgacctatgaacaagctattgcttatttgcgtaaagaagcgatcacattggatgcttctgttccgcgtggctatatacttttaacttataaaaatattccattgggatttgccaagaacattggtaatcgggctaataacctctatccgcaggagtggcgtatccgaagcggttatttgcccgaagaactttcttttgtatgctaaaaggagccataaatttgttcgggaagattgtgcatattgcttttcatagactgacgcaatgcttctccgggtacagacttgcttgaattctataatatacaaattttgttggccttgtacaaaggaaagtgtggttgtcagaacgacttcctgtaggtacacccgtttttccattctgaacagccatacgcggtttttccttttataatcgttcctttgccacatagcgggcaggtttttcccgccaattcgttatcggatgggatagcgggagcggacgtggctgaagaagtgttttttcgtggggtgccggtcttttttttaggctgtttggccgtagagggtgttgcagcttttgtcgctgtttcctctattgcggtgacacggcggtttgtattatcacttaaaacgctgtgtactatttcactcaccatctgctttaattcatttagaaaagtcgttgcatcatagcttttcttttctatttcacgtagtttcttttcccatatacccgttaattcggcagatttcaacagttcttcgcggattagtcccaccagttctattccggtaggggttgcaatcaaatttttgcgttctttacggatataatggcgtttgaacagggtttcaataatggctgcgcgtgtagacggacgtcctattccattttcttttaatgcatcgcgtagctcgtcattatctaccagcttaccggcagtttccatagcgcgcagtaaagttgcttctgtatatggccgtgggggctgtgtccacttctcgtctagtttgggcagatgtggcccgctttctcctttcacaaaagcgggtaaggagtgttcttcgtcactttcacgggcttctgcgtcaggatcggtcataccttcaggcagattggtttgtggtttggcaaagataacgcgccatccgggatctataatctgttttcctgtggctttgaactctatactgtcagcttcgcctattacggtagtagtggcaaacttacagtcgggatagaatacggcaataaagcggcgcgctaccagatcaaatacccgtttctccatttctgtcagatttacaggaggttgtcccgtaggaataatggcatggtgatccgttacttttgaattgtcaaatacttttttggacttgatgagcttttgtcctgccaacggagcggtaaatgctgtgtatggagttagtcccgccaatatattgggacatttgggatagatatcatcgcttaagaaagtagtatctacacgagggtaagtagtcactttcttttcatacaatgactggataagttttagagtttcatcggctgaataagcaaattttttattacattccacctgcagggaagtcaggtcgaaaagacgggggggggcttctgttccttgtttttttgctacttctgtcacagtaaaaggaacatttttgacacgctccatgagtgcctgtccggtagcaagatcaatgatgggaggaattcccctgttctcttcagcctttttggctttcttgggattctctttggcgtcgctttcttcctgagctaattcctcatcgcttttgcggatgatggcagagaatgtggtttcccggtataaagtagccagcacccaatattgttgcggagtgaagttttctatttcttgctgacgctttactatcagtgccagagtcggagtctgcacccgtcctatagatagtatttgtctgttttgtccgtatttcaaggtatagagccgggtggcgttcatacccaatacccaatcgccgatagcacggcttaatccggcttcgtataaaggttggaattctttttggtcttttagtttgttgaatccttcgcgtatggcttcttcagtcaaggatgaaatccatagacgtttcaccgggcagtgtgctcctgctttctgcatgacccatcgttgaataagttctccttcttggccggcatcaccgcaatttataatttcatcggcattttgcatcagtccttctataatgcgaaattgtttttcaatgcccggatcgctgatcagcttaatgccgaaacgaggtgggatcatgggaaggctggacaggctccatgctttccatgagggagtgtattcatgaggctccttcaaagtacagaggtgtccgaatgtccaggtaacctgatatccgtttccttctatatatccgtcttttttgttttttgctcccagtacatccgctatgtcacgggctacggaaggtttttcggcaatacaaactatcatattttttttcgtttctgttcaaataggattgcaaaggtaataaaaacctcggaagagattttgttttgtctttattagttcttcttttataagaatttaaaagtagatatcgggggcttcaaggtcatttcagtgcaagtgggctattaggtatggcttttctgttatttgctgtttgacgaatgtcttttgaacttttctttatgatttcagtttcttttcagaatcctataagaaatttgcatcaaaaagatactataaaacaatgtgattatgaaaaagaattggatgttatttttatttttcgcagcttctgctgcactaacttttagtggttgtagtgatgatgacaatagcgatgttcctgaaaacacacatttggtttcaaaagaagtacaggctgcatttaatgcaaaatatccgcaagctaaagacgtggaatgggagctgaaaggtgattatgctgtagtagattttaattgggatggtggggagcattctgcatggttcaatccgttatcggctgcctggtatatgacagaaacagatgttcgttatgaaaatcttcccgaacctatacttactgcccataaagcaagcaaatatgctgattggcgggtggatgatgtggataagttgactcgtgagggaatggaaactctttatgtcattgaggtagaaaaaggagagtctgagctggatttgttttatttgtctacaggcatattggtaaaaactgttgtagataccggatacgaagaagattatgatgattatttgccgcagcctgatgcaaatggcattatagctattgtcaagcagaaatatcctaatgcgacaattgtggaaatagaacgtgagaaaggtttgcaggaagttactattttagatgaaaacaaagagaaagaggtttatttcaatgagcggaacgaatggatgggaacaagctgggatgtacaggtggcaaatttaccggaagcggtaaaaaaatcggttatggaaaaatattcagactatgtgatagatgatgctgattatgtagtgacacctgataatgaatggtatatacttgatttggaaaacaaacagacaggtaaagagtttaaagcaaaggtagataaggacggtacttggttataattttattatcccatagacttatgctaggtaatcaggtggttgtttactagggccagacagcttttttgttctcaaatattatgacttttgtggcaggcagttggagtgtggaatttgtatttctgttatacatatttttgtgattttgatgagagggtaaaagataaatatggaaaaatagatttgtatgatatatgatattcagttacatttgcatttagaataaaaaatagcatgatggaaacaggattaacttatacttcgactgttgtcgtttcaaaagaaaatgtagctgccactatgggtagtggcgatttgaatgtgtttgctactcccgctatggtagcgttgatggaaaatgctgccatgaatgcggtggcaggcggtttgcccgaaggttctactacagtaggagccatgatgaacactactcatatcaagccctcggctgtgggagatacggtttcggctactgccgtattaaaagaggtagaaggcagaaaacttacttttgaagtgcgggcacaagatagcaagggtgtgattggggaaggtacacatgtacgttatattgtggacaaggagaagtttatgagtaaattgtcttaataattatttgaaattataccacaactgagatcttctgtccttttgtgattctgaatattgtttatttcgataacgggaggatcagaaagaggaatgaagaatgtgctttaataaaaaaatctttaaggagagcaaaactaatgacaatctggaaaacagtgttattagagttctgtcctcctttttcttattcttgcagtgctaggatatattcgtataatttcttataaaacgggtgttttgtcagcgtagaggcatctcctaatataataagtttcatacgtgcacgtgtaatagcgacattcattcttcgcaaatcattcaaaaaaccgatttgtccgtcttcattggcacgtaccagactgattaagatcacatcccgttcctgtccttggaaaccgtctaccgtattgatggtgatgaggtgtcggtaaggcttgaaaaatgcatcccgttttatcagttggcggagatattgtacttgtgctttataaggagaaatcagtcctacatcaatccgttcttccaaaaaacgttcttttcctattttattaatgtaatgggtcagttgggaaatggaaagtgccgcctcggctttattgatacggccgaaactttcacctacaaattcttcattgcagttcattccttccgtattcacccattctataggagtgtcgtaatccagaatcccacggtattttacttcgggagcggatttcaattccccttgatagaaccattccgaagagaaatgcatgatctcatcattcattctgtattgaaccttcagcagggaaacagtttccggtttgttctgcacaatttcctgcatcaaagtctgatccaatccgcctcgtgcagcttccacacattttatggtaggagggagctggcaatggtctcctgccaggactatccggtctgctttgcggatggcgatccagcaagcgggttccaatgcttgtgcggcttcatctataaataaagttccgaatctacgccctgtcagaacccggttggcagagcttaccaatgtgcaagctatgacacgggcttcactgaacaaggcttcgttgatgcggatctccagctcggtggcccggtctttcaatgaattaattttcagacgtatattttcccgttccgctcccttgcgcgaacggttgtagagttcgcgtatggcctttcggatgctccaaagctgcggataatccggatgactttcgaagcgtcgttcgtaggtaaaggataacatcttatcattgacacgggtaggattaccaatacggagaacgggaacgccccggtctaccagtttctcactaatccagtctacagccatattgctttgagcgcataccatcacttggttttcccggtgtagcgtttcataaatggcttctactagcgtggtggtctttccagttccgggagggccgtggacaatggccacatcttttgcatgcattactttgttcacagcctcttcttgtgaattattcagccacgggaaacgagtgaaaccaaaactgaacgtttgtgcttttaatgtgccgtggaaaatatcccgtagttctgccagacgattgtcttttgctttaataacttggcttaaggcttcaaacatcagtcggtaactggtttcatcaaaataaagttgaacccccaactgacgctcggttgcctgtatgttgagtaaagcgtctgccgatggcaaaacgatgaccatgcggtcctcatccacataattcacagtggctgtgaaattgaaataatggatgtttcccggggcgtcttgagtgaaaaaacaaacaggacgtccgaattcgaatacatgttctatttctttgtcctcctgtctttccatctctataaccagttggtttaaagagttgtaatagcttcttcctgtgctgacaggataccagcacatgccacgtttcactttgcggtcgatgcccatcgcttcggtttgttgcttgaaagtttctttttcgtaattatattccatgtgaagcaacaactctttgcgttgtaatttgttaataatagtagagagggatttatgctggttcatatttattcttttttctataagaattgcaaagataataattatccctctaaaagcactttatgttttattttgttaaacgtattatagattacgcaagaattcaattcttttttctatcttgccaaaaataaaaagaatctaaaactgtaataattataaattgtgatggatatggtatatgacttggacatgttaaaagccttttatgcttcttttgaaaagaagatagggcgggtaagagcagtgttgcagcgtccgttgacgttggcagaaaagattctgtacacgcatctgtatgatgatgcactgttgaagaaatacaaacgtggtgaggattatgtgaatttccgacccgaccgtgtggctatgcaggatgcgacggcacagatggcgctgctgcaatttatcaatgccggtaaggagactgtggctgtcccttctaccgtgcattgtgaccacttgatccaagcatataaaggtgccggtccggatattgcgacagcaacagaaagtaaccgcgaggtatatgactttctgagggatgtgtcttcgcgctttggcattggattctggaagccgggtgcgggtatcattcatcaggtagtgctggagaattatgctttccccggaggtatgatggtgggtactgattcccatactccgaatgccggaggtttgggaatggtggcaatcggagtcggcggtgctgatgcggtggatgtcatgaccggtatggagtgggagctgaaaatgccgaaattgatcggagtacatttgaaaggtgcgttgaacggatgggcttctccgaaagatgtcattttaaaactggctggaattctgactgtgaaaggggggacgaatgccattatcgaatattttggagaaggtacggcttcactctcggctaccggcaaagcgactatttgtaatatgggcgcagaggtgggggctacgacttctcttttcccgtatgacgaacggatgaaggtgtatctggaggcgaccggacgtaaggaggtagctgcaatggccgatgcagtgtctgccgatttgcaggctgatgcagaagtggttgctgatccgtcagcttattatgaccgggtgattgaaattgatttgtccgaacttgaaccttatattaatggtccgttcacaccagatgccgctactcctatttcagagtttgccgagaaagtgctggcccatggttatccgcgtaaaatggaagtgggcttgattggttcatgtaccaattcatcttaccaggatttaagccgtgcggcatctattgcccgacaggtagatgaaaaacagttgagtgtggcggctccgttgattgttaatccgggatcggaacagattcgcgctacagccgaacgtgacggcatgatagatgcttttctgaaaataggagctactataatggccaatgcttgcggcccttgtatcggacaatggaagcggcacacagatgatccgctccgcaagaactcgattgtgacctctttcaaccgtaattttgccaaacgtgcagacggtaatccgaatacacatgcgtttgtagcttctcccgaagtggtgctggccctgaccattgcaggtgatttgtgtttcaatccgttgaaggatgctttgatcaatcaggagggtgagaaggtgaaactgagagttccggaaggggatgaattgccgtcgaccggttttactcagggaaatcctggttatttggctcctgccggtgcacaggtggaaattaaggtgaatcccgaatcacaacgtttgcagttattggctccgttcccggcatgggatggaaaggattttacggatatgcctttactgattaaggctcaaggtaaatgtaccacagatcatatttcaatggcaggtccgtggttgcgtttccgtggtcatctggaaaatatttcggataatatgctgatgggggcggtgaacgctttcaatggtgaaacgaacaaggtgtggaaccgtttgacaaatacgtatgagggtgtgtcgggtacagccaagcaatataaggctgaaggtatcagctccattgttgttgcagaagaaaattatggtgaaggttccagtcgtgaacatgccgctatggagcctcgtttcctgaatgtaaaggttattttagcgaagagtttcgcccgcatccacgaaacgaatctgaagaagcagggaatgcttgcggtgacctttatagacaaggcggactacgacaagattcaagaacatgatttgattaccgtcagcggattggcggactttgcccccggcaggaatctgactgtgactttacaccatgaagatggcactcaggatagttttgaagtgcaacatacctataacgaacagcagataggttggttccgtgccggctctgctctaaatgcaagataaaaaatgaagaagacagtaccttatattacaggcgacggagtgggagtggaaatcactccagccatgcaagccatagtgaatgcagccgtgaagaaggcgtatggcaatgaacatgaaatagaatggatggaagttttggcaggagagcgtgcttttaatgaaacaggctcctggttaccggatgagacaatgaaagcgtttcaagaatatggcgtagggattaaggggccgttgaccactccggtgggaggtggtatccgctctttgaatgtggctttgcgccaaacgttggatttgtatgtatgcttgcgtcccgtacgctggttccgtggagtggtatctccggtgaaggagccgcaaaaagtggacatgcatattttccgtgaaaatacggaggatatttatgcaggtatagaatgggaagccggaacaccggaagctgagaagttctatcgttttttgcatgatgaaatgggagtggctaaagtgcgctttcctgaaagttcttcgtttggtgtaaaacctgtgtccagagaaggaacggaacgtttggtgcgtgcggcgtgcaaatatgctttggagcatggcttgccgtcggttacgctggtgcataaaggaaatattatgaagtttactgaaggcggcttcaaggaatgggggtatgaactggcggaacgtgagttcggagatgccattgcgtcaggcaaattagtgataaaagactgcattgccgatgcattcttgcagaataccttattgattcccgaagagtattcggtggtggctaccttaaatttgaacggagattacatttcagaccagttggcagccatggtaggaggtattggaatcgctcccggagcgaacatcaattataacaccggtcatgccatttttgaagcaactcacggtacggctcctaatattgccggaaaggatgtggtgaatccttgttcattaattctctcggctgttatgatgttggagcattttggttggaataaggcggcggagctgatagtaaatgccttggagtccagctttggcgaggggcgggctactcatgaccttgcccgttttatgcccggaggtgtttcgctcggtacatcagcatttacaaaagaaatcatagaaagaataaactcctaaaaactcacggatatgaagaaagaatatatcatttacaaactctccgaggaaatgaagaatgcgacccggattgagaacgaattgttcaagaagtttgatgtaaagcgcggattgcgtaacgaagatggcaccggtgttttggtagggttgaccaagataggcaatgtagtagggtatgaacgtattcccggcggaggattgaagccgattcccggcaaacttttctatcgtgggtatgatttggaagatttggcacatagtatcattaaggagaaacgttttggttttgaggaggtggcttatctgttattgtccggtcatttgcctgacaaggaagagttggcttctttctgtgagttgattaatgacaatactccgttggaacagaagaccaaaatgaatatcattgagttggagggaaataacattatgaacattctggcccgtagcgtgcttgaaatgtaccgttttgacccgcaggcggatgatacttcgcgtgataacctgatgcgtcagagtattgacttgatatccaagttcccgaccattattgcatacgcttataacatgttgcgccatgccacgtatggtcgttcgttgcatatccgtcatccgcgtgaaaaactgtctatcgcagaaaacttcctgtatatgttgaaaaaggattatacggagcttgatgcgcgcacgcttgatttgctgttggtacttcaggctgaacacggaggtggtaataactctacttttaccgtccgtgtagtttcatccagccgcacggatacttattcggccatcgccgcaggtatcggttcgttgaaaggtccgcttcatggaggggcaaatatccaagtggcggatatgttccatcatttgcaggaaaacatcaaggattggacgaatgtggacgaaattgatacttactttacccgtatgttgaataaggaagcgtatgataagaccggtctgatttatggtatcggtcatgcggtctatacgatatccgatcctcgtgccatcttgttgaaagaattggctcgtgatttggcaaaagaaaaaggaaaggaggaagaatttgcttttctggagctattggaggaacgtgccattgctatgttcggaaagattaagaataacggcaagacggtgtccagcaatatcgatttctattcaggtttcgtatatgaaatgattggtctgccacaggaaatatttacacctttgtttgcaatggctcgtatcgtggggtggtgcgcacaccgcaatgaggagctgaattttgaaggaaaacgtattattcgtccggcctacaagaatgtattggaagaactggaatatgtgccgttgaaacagagataatgatttagaggcacccggtttgcgataagctttggtatgattgccttagctgggcggccatgcggtctgtattgttgtaaagaaaagtaagatatcttcgtggacaaagtaagatatgttcccgggcaaagtaacactacttacctgccctacgaagatatcttacttttttcagtgaggtatggccgttcataatactctgtatagaataccttgaaaaatccttcaaatccttcattcttcccgcaaacgccctgtccgtcggcattccggctgaaggattggactcgggaatccttcagccggggattggaatccttcagccggaccgatgttcctccgattcttagggatttgattttcctgaaggatattttccggctgaaacatttcacgatgcatatccttcagccggaatgccgacgggcagggcgtttgcggaatggctgaaagatctgaaagaaaagtaaggcggttcggcatgtagatgccgttatggaaaaaacaacaggtcaaattttaaaaagctcttgttctttcaatgaaaacgtcttgttcttttttttaaaggccttgttcttttcagaaaagaacaggacgtttgaaaggttagtaacgtgtggggtgacacgttactaatgtgtgggctgtaagattagtaatgttacaggtgaaagattatatatcttacaagtgatacatatatgaagttccagtatataaaagataaagggaaggcaggtactactggtttttgcaatgtagatacatctcagccggattggtttataaggcaaacctttggggtggaaatcaatggaaaacctgtacaaaatagtacagcgctctctaaataaagccttctctgcgataaaaatcgtatccttttcttgcaaaaaatctcttaattgttgctttcctctgatttttcccttaaatttgttagtgacttactaaatttaatacagggaggaacgagtatgggacaacagacttttgaatttttgttattagcaatgtccgcacttgcggtgattgtatttgtagccctctattatgtacgtgccggttatggtatgttccacaccccgaaatggggactttcagtgaacaataaattaggttgggtgctgatggaagcacctgtattccttgtaatgctttatctgtggtggaacagcagcgtgcgttttgatgccgctcctttcctcttttttcttctttttgaattacattatttccagcgttcttttctattccctttcctgatgaagggaaagagccggatgccccttgccattatgttgatgggagtggtctttaatgtcctgaacggactgatgcagggcgaatggttgttttatctggctccggaaggactctatacagatgcctggctcagtactccttctttttggcttgggatcattttgttctttatagggatgggcattaatctgcattccgacagtgtgatccgccatttacgtaaaccgggcgatacacgccattatttgccacagaagggaatgtaccgatatgtcacttcgggcaactattttggcgagttggtggaatggatagggtttgccgtactcacttgttcgcctgctgcatgggtgtttgtactgtggacgtttgctaatctggctccacgtgccaattccatccgtaaccgttaccgggaagagtttggtaaggatgcggtaggaaaaaagaaaagaatgattccttttatttattgaatttgaatagtatatcgtttctgtttcaggaaatgatgaaagcgaaacataacatatgaatgatgaactctaaattatttactcccgcttctatcgggccgctgactttgcgtaaccgtacgattcgttcggctgcttttgagagcatgtgtccgggtaatgcgccgtcccggcaattgaaggattatcactgttcggtggcagcaggtggagtgggaatgactactattgcttatgcagctgttacacaaagtggcctttctttcgacaggcaattgtggatgcgccctgaaattataccgggattaagggaaataaccgatgcggttcataaagaaggagctgctgcaagcattcagttgggacattgtggaaatatgtcgcacaaaagtatttgtggggtaacacccgtaggagcttcttccggttttaatctttattcgcctacttttgtgcgtggcttgcgcaaggaggaactgccgcagatggcaaaggcatacggtcagtcggttaattgggcacgtgaggccggatttgacgcggtggaggtacatgcagggcatggctatcttatcagtcagtttctttcaccttacaccaatcatcgtaaggacgagttcggcggctcgttggagaaccgtatgcgctttatggatatggtaatggaggaagtgatgcgtgccgcaggtaatgacatggccgttctggtaaaaaccaatatgcgtgacggttttaaaggcggcatggaaatagatgaagctgtgcaggtagcgaaacggttggtacaagacggggctcatgcgttggtgctgagcggaggctttgtaagcaaagcgcctatgtatgtcatgcggggagcgatgcctataaaaagtatgacacattatatgaactgctggtggctgaaatatggggtacgtatggtaggtaaatggatgattccgacagtaccttttaaagaggcttatttcttggaagatgcattaagattcagaacagaaataaaggaaattccgttagtatatgtgggagggctggtatctcgtgaaaagatagatgaggtattggatgatggttttgaatttgtacagatgggaagggcgttgctgaatgaacctggttttgtgaatcggttgcggactgaagaaaaggctcgttgcaattgcggtcatagtaattattgtattgcgagaatgtacactattgatatggcatgtcacaaacatctggaagagaaattacccctttgcttggaacgtgaaatagaaaaattagagaaccaatgagtaaattagccataataaccggtgccgatggaggaatgggtactgaaataacccgtgcggtagcacaggccggctatcatgtaataatgttgtgttacactctttttaaaggagaggagcgtaagaatcagttgattttggaaactggcaataaagagatagaagtcagacaagttgatctttcttccatggcttctgtgactaatatcgcggacgacttgttggggcgcggaaagcatatcgatttactgatgaacaatgcgggaacaatgagttccggtggtttgattacaacggaggatggtttggaatatacggtagctgtgaattatgtggccccttttttactgactttgaaattattgcctctgatgggtcaaggaacccggattgtgaacatggtttcttgcacgtattccatagggaagattactcctgaatttttgattcgtggaaaaagaggcagtttttggcgtatccctgtttacagtaatacaaaattggctttgtggctttttacccgtgaactttctgaaaggctgaaaacagaaggaattactgtcaatgctgccgatcctggtattgtttctaccaatatcatccgtatggatatgtggtttgacccgttgactgacatactgttccgtccttgtatccgtactccgaagcaaggagccgcgacagctgtcagtttgcttttggatgatcgatggaaagaagttacagggcaaatgttcgcttcttgcaagcctaaaaaagtaaaggataagtttatgaatcatccacaggcaagacagctttgggcggatacgaaagcatatttggagaaactgaaattggaggagccaattgtctgagaattcctttaaatacataaaaagccgtatcattacttaaaagtagagtggatacggcttttatggtcggtgaagagtgtctggtttcggattgcagtgtagttgaggttattctttcttggctgcttgttcagccagcatctgttcacggcttttactttgagtcacaatataaactcccgtgaataccagtgccacagctattcctttggcaatgccgaaggttcccattcctaacaagatagagacactggttcctacgataggctgcacatagttgtacatactgatgacagtagggcgcaatgttttctgtccgatcatcatcagaatataggcaaggaatgttccacctacaatgacgtatgcaacacaagcccatgtagaagtggaaatttcttgaaaatgtatggcggaaacctcatgataggagaacggaataaagcagatggcggcgtatgtaaacatccacttcatcaaagtgaagatgttgtatctgctgatcagtcctttaaaaatagccagatagaatgagaaactgatttgtgccaacaggcaaagcaaatctccgggaatacttccgccttttccatctgttgagccttggctgcttaatatgagtgtcaaggctccgatggaacctagaaaaatgccaatcacttttttccctgtaaccggttctttcagataaatggcagcgacaatcatagtagcgataggggctgtggttgttacaatggaagcatcgatgggggaagtcagtgatagtccgaaagtgaaacatccctgattcaggacgatacccaataatcctgcaaagaacaacatcatcaagtcgtgcggctttacttgttctttaggagcgaaaatagaagctatccaaaaacagatagcacctcctgtcattcgaaatgtagcgagggaaagacctgaaataccgttttctaacgccgttttaccaattggggacatcaatccccacattatggcagcgcctagcaatgccaaatgtcctttgtacttttgaatagccattctttttaccttaaataacagtgcaaatgtaggaggttttttttatattttctatctttgcttataagtaaatctatcaaaaatgaaaaaacaagctgattatataaaacgtattgagataaagcggctttggggccgtaaagatatctcatgggaactgcgtccggatgtcaatattctgagcggagtgaatggtatcggcaagagcactatcctgaacagatctgtgaacagtctgacggctttggaaggcggagcgttgagtaacggttcgactcccggggtacattttgtcttttctccggaagatgcgaccctgatacactttgatgtaatccgtagttttgaccgtccgttgattcattcggaacttctcgaaaagatggcggataagaatgttaagacagaattggattggcaactttatcagttgcaacggcgttatttggattatcaggtaaatattggtaaccgcattattgagtgccttacttccggtggccctgacggtcagcttcgtgctgccgaaatgtcttaccccaagacgaaattccaggatttgatggatgacttgtttggtgaaaccggtaaaaaaatcattcgtaaaagtaatgagattttgtttgaacaggatggagatatactttatccttatcaactgtcttccggtgagaagcagattttggttattttgctgacggttctggtacaagacaaccgtcggggagtcctgtttatggatgaacctgaagtatccttgcatgtggaatggcagcaacgccttatttcattgatacggcaattgaatcctaatgtacagattgtgttgacaactcattcgcctgctgtgattatggatggctggctggatgcagtgaccgaggtgagtgatattacaaaataaacaatttctaacgacgatactatgggaaaaagattgtccgagaatctgtcctccttatatattggtgcggccaacaaattgaaacctaaatgttcgcgacgcaagattattgcatacgttgagagctatgatgatatttcattctggcgtaccttgttaggtgaatacgaaaatgaaactcgttatttcgaagtgatgcttccttcgaaaaccactttggctaaaggtaagaagtctgtgctgatgaatgaactgggacctcagttgggacaaaatatgatagcttgtgtagatagtgattatgactatctgttacagggggctacccatacttcacgttatattataaataacaaatatgtttttcatacctatgcatatgctatagaaaactatcagtgttatgctgaagcattgcatgaggtttgtgtcatggcaacgttgaatgaccatccgttggtggattttgtcgcttttatgcgtatgtattcccaaatagcttatccgttgttcatttggtcggtgtggttttatagaaaacataatctttccgaattttctttgcttgacttctgttcgtatgtgaaattggatagagtcagtgtctatcatcctgaacggagtttagagagtatgagccgcagggtgaggcgtaaattattggaactggaacgccgccatccgaaagccttggaggaaatagaggcgatgaagcgggaatttgccaaattgggagtgaatgaggacaatacctatatgtttattcaaggacatcacattatggatagtgtagtgatgagattgttagtacctgtctgcaatgtgttacgccgtgaacgtgaaacggagattaaagaactggcagagcataatatgcagtttcataatgaactgaccagctatcagcgccggcagttgggagtagacattgtactccgcaaacataccagctataagttatcacctctttataaaaaattggaagcagatatagaacgtttcttgaaacatatctgaatcggttatttcttatgggaggcaagtgctttggctatgaaatgatctagtgagaatttacccggtcctgctatatacaataatatgaatactaccagataaataaaggctaattctttaacggcgaaaggatcagaaccatgaacaacaaagaatgcgatacacatggtgaagatcatcggaagcattgccaagcgataaaggaatccgaaaatgaaagccatcgaacaaaccatttcaccaaaaatagccagtaccagtgaaagttggctgcctattcctaaaggatcgggaaaactgccggacatgacatcgtagttggcccatttctgtacaccgtgcgacatgagtaaaataccaaacaggattcgtaaagctaatatcagaagtgacatagcagtgccatcgggcttggatggaaataagaatttataaatgactgacataatacgtttttatttttttgtttatactatatttatataaacgtaacaaaagggtgaaatgttcaaatcattcactgtttgtttctttggagatggttgattcgctcatattaattttttattgtagaaaaactcttgaaacgaatgtcaggacttcgtgcaaaaggaataaaaaaagaacaattataataaatattagttctatatggtataatgtttgtcgtaccttaggtaacgataaaagctaacatacgaatatatgaaaacaattaaatgtattggagtgctgacatccggaggggatgcttctggcatgaatgccgctatccgtgcggtaacccggagtgcaatttgtaacggatttaaagtgaagggtatttatagaggatatgaagggctgattaatggagaagtgaaggaactgaccacccaggatgtgagcagtgttattcaacgtggaggaacgatgttgaagacagcccgttctgctgaattccaaacagtagaaggacgcaagaaagcatacgatactatgcagcgagaaggaattgatgctttggtgattataggtggaaatggttctattacaggagcccggatttttgcggaagaatatgatgtgccttgtatcgggttacctggtacaatagataatgatctttatggtactgactttaccataggttacgatacggctttaaatacgattgtggaatgtgtggataaaatccgtgatacggcaacctctcacgaccgtatattctttgtggaagtgatgggacgtgatgccggttttctggctcaaaacagtgccattgcttctggtgctgaggcagcgattattcctgaagatcgtacggatgtggatcaattggagaaatttatcgggcgcggttttcgtaagacaaagaatagcagtattgttattgtttccgagagtccgaaagacggaggtgccatgcattatgcagagcgtgtcaagaaagaatatcctcaatatgatgtgcgtgttaccattttagggcatttgcaacgtggaggttcgcctagtgcttatgaccgtattcttgccagccgtctgggggcgggagctattgatgccatattggaagggcagcgcaacgtgatgattggcattcataacgatgaggtggtatatgtacctttttctgaggcaattaaaaaagacaagccccttgataaatcgcttatcaaggtgcttgatgaattatctatttaatgaaaataatcatgaaaggagaagcggaagtaattcttctgctttttctatgatatgtgccggatgtaaggcttccaattctgtgcgcggccggaatccccatgccacacctatagctgttactccggcatgatgcgctgtttgcatatctacattagaatcacctacataaagtatatcttcctgtttgactcctgcttttgtcatgatttcgtttatgatggatggatcgggttttgcggggataccttcgcgttgtcccagtacttccacaaagtttatttctggaaaatagtgtgctattaactttcgggtagctgcttggtatttattggaggcgaccgctatcatgatcccttgctgttgcagtgtttttaataattcggagataccgggataagggcggcttaaatcggcattgtgctcatcataataagggatgaattgtgaacgtatctttaatacattctcttccgtacgctccccttcaggcagagcacgctcaaataatttattgattccgtttcctacaaaaaaacggtatgcttccatttcatgtgtaggatagccataatactgtaaggcttggttggtggcggcagctaggtcggcaatagtgttcagtaatgtgccgtccaggtcgaatattacaagtttcttcatatttgtacttcttttatcggtgcaaagttactatttttgtatgcaaactaataataatgcttatgaactttctagaattagtgaaggcgcgctactctgcacgcaaatatgccaatcgtcctattgaggctgaaaagttggattatatcatggaatgtgtacgttttgcaccgtctgcagttaattttcaaccatggcgtttccgtattgttacagatgaggccgtactgaaaacgttgtattcatgttataaacgggaatggcttgctacggctccttgtatcattgtggcttgtgtgaatcataatgagtcttggcatcggcgtgccgataataaggatcacgctgatattgacattgctattgcagtagaacatctttgtctggctgctgccgaacaaggactgggtacttgttgggtttgtaattttgacactccgcgatgcagtgaggttttgggattgcctgaaaatttggaaccggccgtcttgattccggtcggttatgcggaggatgaacccacagaaaagaagcggaaaccattaaatgaaatccttctttaaaaaatcacaaaaacacctttcggagtgccatcgggcaggcagatttaatttccttttacagtggacgaagatactattaatctcttggcctgatgactgttccggattttaagctcattctttttagtctcttcttattttctgataattttgcatattttgtattccatttatgatagaagtaaagccgaaatggctaaatttgagcactttttaggctttgaataacctatgagtgtagtaagtactattaataacactaaaaattatggagaacataggagttggattgatgttgatggtggtcggtatggcgactgtctttgtcattctcctcatcgttatctatctaagcaagtaccttattactgttgtcaacaaagtggctcccgaagaagctcctaaaaaagcacctgctgtagcacctacggcagatactggtgctatggatgctattaaggcggcagttgagattttgacggcaggtaaaggtcaggtgataaagattgagaagttataatccaaaaaaagaaaaacacatttatcaaaaatggaaagagaagtaaaatttagtctggtctttcgcgatatgtggcagagtgcaggtaagtacgtgcctcgtgtagaccagttggttaaggttgccccggctattattgaaatgggctgtttcgcccgtgtggaaacaaatggtggtggttttgaacaggtaaatttattgtttggtgaaaatccgaatagagctgtgcgcgagtggacgaaacccttccacgaagcaggcatccagactcatatgctggaccgtgcgctgaacggtctccgcatgagtcccgtcccggcagatgtccgtaaattattctataaggttaaacatgcgcaaggaacagatattacccgtactttctgcggattgaatgatgtccgcaatattatcccttctatcggctatgctcacgaagccggaatgatttcacaatgttcgctctgtatcactttttctccgatacatactgtggaatattatgtgaatatggccaagcagcttatagaagccggagccgatgaaatctgtattaaagatatggccggcatcggacgtcccgtttcattgggaaagattgttgccggaatcaagaagattaaaaatattcctatacagtatcactctcatgcggggcccggattcaatatggcttctattttggaagtatgccaggctggttgcgactatattgatgtaggtatggaaccattgtcatggggaaccggccatgctgatttgattagtgtgcaagccatgttgaaagatgccggatttaaagtgcccgaaattaatatggaagcgtatatgaaagtgcgttccatgattcaggagtttatggatgatttccttggtttatatatcagtcccaaaaaccgtctgatgaattctttactgattgctccgggattgccgggcggcatgatgggaagtttgatggccgatcttgaaacgaatctggaatctatcaacaagtacaaggcaaaacgtaacctgccgtttatgactcaggatgaattgttgatcaagttgttcaatgaagttgcttacgtatggccgcgtgtgggttatcctcctttggttactccgttcagccagtatgtgaagaaccttgccatgatgaatgtaatggctatggagaaaggtaaggaacgttggggaatgattgctgatgatatttgggatatgattttgggtaaagcaggacgtttaccgggtaaactggcccctgaaattattgaaaaggcagaacgtgaaggccgcaagttctttgatggcaatcctcaggacaattatcccgaccagttggaaaaatatcgtaagatgatgcttgaaaaacaatgggataaaggacaggatgacgaagaactgtttgagtatgccatgcatccggcccagtatgaagcttataagagtggaaaggcgaaagaagacttcttggcagatgtgaagaaacgtcgtgaggagaaggcgaatgccactactcctgtcgaagctgaaaacaaaacaaaagtactgacagtggatgtgaacggacaaccttatcgtgttacagtggcatatggtgctgtagatcctgctacgctgacagctgcttcgggtgcagttcctgcacaaactgctcctgctccggtaggtgaagggaaagatgtgctttctccgttggaaggtaaattcttcttggtaaagaatgctcaggaaaccccgaagaaggtgggtgaaaaggttaataaaggtgatgtgatttgttacgtcgaagcaatgaagacctataatgcgatccgtgcggaatatgacggtactataactgctatttgcgctaattcgggtgacacggtttcagaggatgacgtattaatgaaaatagtataatggaagatatatttgaaagactttatgatatgactgctttcagcaatattattgctgagccgcaattcttgataatgtatgccattgcgttcatcttactttacttgggtatcaagaaaaagtacgaaccactgctgctgattccgatagctttcggagtgttgctggctaactttcccggtggtgagatgggggttgtccaggccgatgagaatggcatggtaatggtgaatggagcactgaagaacatctgggaaatgccgttgcacgaaattgcgcacgacttgggcctgatgaactttatctactacatgttgattaagaccggttttcttccgcctattatttttatgggggtaggtgctttgacagactttggtccgatgttgcgtaatctgcggctttctattttcggagcagctgcacagttgggtattttcactgtattgctggtagctatcttgatggggttcactccgaaagaagcggcttcattggggattattggtggagcagacggtcctaccgctatctttaccactattaaactggctccccatttgctagggccgattgccattgccgcttattcgtatatggctctggtacccgttatcattccgttggttgtgaaaatctggtgtacgaagaaagaattgagtatcaatatgaaggaacaggaaaagaaatatccttcttcggtagaaatcaagaatcttcgtgtgctgaagattgtatttccgattgtagtgactacggtggtcgctctgtttgtgccaagtgcagtgcctttgattggtatgttgatgtttggtaacttgattaaggaaataggtagtgatacttcacgtttgtttgatgcagcttcaaatagtatcatgaatgcggcaactatcttcttggggttgtcagtcggtgcgacaatgactacggaggcatttttgaactggactactatcggcattgtggtaggtggtttcttggcgtttgccttgtctatttccggtggtatcttgtttgtgaagttgatgaatcttttcaccaaaaagaaaatcaatccactgattggtgctacaggtttgagtgctgtgcccatggccagccgtgtggctaatgaaattgctttgaagtatgactccaaaaatcatgtgcttcaatattgtatggcaagtaacatttcaggagttatcggttctgccgtggctgccggtgtgctgatttcattcctacaataaaatacattgtatttaaattattcggacacgaattatacggaaattacaggtgttttagacaatactgtaaaatctgtatagttcgtgttttttattcattctctctgtatcgttctcctagctaaaacaaatagaataggccctctcctcacgaagaaagcctatcatccgattaatgtttaatataagagagagttttatagtcctaacagttcattgaacttctctgctgttttgggatctgacggacgtgtcatattagcagagatgatgttaccatcccgatccagcaggataaaacggggaatgccgttaatgaggtaagcatccataaaggtcctgtctgttcccatgtgtaactggatccctttcaactgctcctttgttaccatgttctcccatgcctttttgttcttgtcgcatgacaggctgacaaaatgaatatcctttcctgcatatttctcttccagttcctttaacgcgggaagttctccacggcaaggaccacaccaggtagcccacacgtcaatatagatatattttcctttcaagtcagtcattgaaaccgtctttccatttatatccggataggagaagctagctgctgagggattgcctgatcttaatttttcccacttggtacaaagtgcgttgaatttttctatggactttgtatccttcacgtgtttgcggaataggacaatcagtccgtctgcttcatccagtccgttattgtctacaaagttataaacaaattggtcaatcagaaattctgcaaccttttcatcctgtatggttgcatctatgtagtttacacattgttctgttgaacttgatgcaatcgtttttcctttattactaaaggcgctgatagcatcgggaaggaaagccttatattctttcagcgctaataaaccggcattgatcggagtaatagcttccagtttctcataatatgctttggaaggaatatagttgtcatcctttccaaaatgaggatgatacaaagcgtatttggagaaataataatacgtatagaattgcagacgtattttttcctgtgcagtgaaatcggccggaagttttgcggcttccaatacttggcaattgactgcatacaggctgtctcctttgtgtataagggcggcttcctgcattttcatgtcgggcatgccgagtgatcggagctctttgcttcccagataggtgttgatagcggcgcctgctccttcaaaggttgtgtttctccacatgttatcactgtcgaatgacaaagtaaggtcttgattagggtccaaataaagggtacggcgtccgcgtgtgtattgcatggttacatattgcggagtgaatcccgtgatttctatgttgccgtttcctgcggcgtcaatcgctacttctttttgttcgccactttggctgaaagtcaatataactttgaccttctcattgggattggtgaccttaaaagtgagctttgcagcttccgcagcagtgaaggtactcagcgcaaggccaagtaccaggatggattttagagttctcatcttatttttttcttttaggtttcattttcaatgcatcgggacgcatgttatagactttctttccgtatgcgggttctgtgctgaggctggcagggatgggggctttgccgttcagtttacgaagcaccatttccaaggcggctgcatattcctgatggatgaaagcatcatctctgtctgtttggttataagcaatgtattgcagatagcctacacatttgttgaaccagaattcgggaagttcctctgccttgtatcccaaacgggcgataaatttcaatctgccgatcaactcttgttggttgattgtggtatctgcaatcatcgcatcaatctgggtagctgccgcttcatacttttgttcccggatatcattattgatacggatcattttcaggttgaaatcttttccttcatagttgcataaggcttcaatttccgccaattcgccgtatgaagtttcttttgccagtttggcatcaacattttttttaccgaaacgctgacagaaatctgcataattgtctgatacttgctttaggtacgggttcatgccgttgatggtgtttacatatacttcccatacatccggatcagtcagtttggcgcctccttttattaattcgtcaaaagcggtctgtacgttcttgcgtgcatagactgaatagtgataattgatgtaatcaattaaaaaagcacgctccctgtttcctttggtatattggtcttgcaggtaaaaagaacgtttggtaggaacggttgcgtcttttcctgtctgaataaactgttcgggagtctgacgactgctgctgtgatggacgatttcttcggtagcaggatctatgaatgcataggtgggataactgcgtacaccgtatttcttggctaatgtaactccttcaccttcttcagcatcaattttgaggttgatgaaagtttggttatagtagtaacccactgtaggcaatgagaatacggtttgtgccatattcaggcaaggtccgcaccattgggtatagaaatcaatgaatatcagtttattttctgctttggccttggctacggcttctgcccaagtagtgccgtgcaggaaattgattcctgcattttgggcatttaagtgaatcgcatagatacatgcgaaaatgagtaagatatattttttcatgtctttgaatttaatatgttaataaccggggttttgtttacattccagattagaactgatttctgacgacggaatggcatcaatacggcggtctatgatgcgttggtaataattgtctccttgtgcttccgatttctcatattctttttccaaagcttctcttaacgtcttgttcaaggcaagcagacgggtgaaatcgggtttctccgtgtatcctgcaaaacggatcatggcaaaccattcatgccagttctcgaaagacaattccagcatccattcgttgaatatggccgtttccagttcttcgttattggctggaagaataatttcggctcctgctctttcgcgtagtttacggatcggtgcataggcttcggatatagaggctcccgaacgatacaaggcttcggctttaatcagataaagttcggaaacacggctgaagatgacaggcatgtcattggcatcgttcagcagctttttcactgacttcagattataagccacggcagaactgcggctgtccatcaaactgtctactttagagaagatggcatcggcgcgaggatcatcccccaccagttccacatactcattggtgggcccccaatagccttgtttcttcgtggggctgttaccataacattgctggcgggtggaagtgttggttgcatctttttggtcgaatacacgagcgaacagaatctctttggttgttgaaaacttatcaaaaacgtcaccgtagtttgcttccggcaatggagcatttgtatcaatcgcatcattgactgctgctaccgcttctgtgtattttcctgcatacagcaatactcttgcctttaatgccttggctgcttctttagaagcttgtgaaagctttttccaatcaggagctttttcaatcgctatttccagttgatccagaatatattgataagaatcggctacggagctacgcgccttcaaagcattggatacggatggagcttcattgcgcatgaccaccccgtattcactgttcatatcccaaaattcgcagtaacgaaccaagacgttgaagtaggccagagcacgtaaataggctatttcacctaacacttcggctctacggtttcctgagaactctccgtcactcatacggttacaggctgtttccaggaagttggcatttttgattacagcgtaatctgcgtcccattccgttgcatcactgaatgatagggtaggcaacattcgctcggagtagtaaacggcattaccggcgcttacaatttcttgacgccacatggttccggctttgaatgaaccacttactgtaggaaatatgacattgaacccattcccgggcaaggagtaatagattccgtttaaagctaactctacagcagcgggtgttgtgatggcgccgtctaaatctgcttcgaattcgggcttttggtccaagacatctaccaactggcacgaggaaacgcccattgtaagtaaagctaagaatatatattttttcattcgattatacatttaaatgattataagttaatttttaaacctgccgagaaagagcggaaacctggataagctgaggtttcatagttaccgccataattactgttactgtttacggtagcagggtctgttcccggataagaggtgatcgtgaacaaattggtagccgagataaatagttgtcctttaattactttgtttaaaggtaaattataagtcagacgcacttcctgcaaacggaagaaggaggcatcaaacaattcatgatcggtgagtctaggtacaccgtcacctatatacaaggccgggtatttggcatctttgttggtgtcagaccatctgtcattcaatccatagtcaatcaaaccggttaattgtccgggtagattctgcaatgtcttgttatagatcttcaagccaccaatctgatatccgaagttggcgaacaaactaaattgtttataagataaattagcagtcaaaccgccgaacaaatccggatcaggattaccgataataacacggtcattgtagttgatgattccatccccgttcaggtctttgatttccaaatgtcccggttttaaggagttcccatcgtaataactttgtccctttgatttagcataggcgttcaattcatctattctggcctggtcttgtatgataccggcatattcataaccatggaaagctcccattggataacctacagccaatacttggtcggcatagctgccttgaaccactacatccatagctgattgtgctttaccttcttcaaccagtctggtgactttattcttgttatgtgacatattcaaggtcaaatccaaactccagtctttagtagataatacacggcccaccaggtttatttcaataccgcggttggtcagtgctccgatgttacggttcatctgcatggagccgccggttgcgctgggtgggaaatcaaatgaccagatcaagtctttggtatctttgatatagccggagatagaaccggtcagtcggtagtcgaacaatgcgaaatcaagacctaaatcatattgggtcgatttttcccaacggatgtcgcggttacccacttgtttgtgtataatggctgatagattattatagctggttgcttcgtataaatcacgattagagaagctggttaagttttgggtaccggtagtacctacgctggcacgcaatttcaaatcattaatgaatgtcaggtttttcatgaagttttcctgagagatacgccacgcaatggctcccgaagggaagaaaccataacggttgttcgaaccaaacatggatgaaccatcataacgtcctgtaaaagtaaacaggtagcgctccattaatttataattgatacgggcaaatgaagagaacaaaccacttgcattatatccgttgccccaagatgagatgcttgcagcacttcccagattggtgtagatgtcattatccggataagtttggccgttcatggtggtgctacggctgatgccgcgttcaaaggagacaccggctacggcatccagtacatggttcttgttgaactcatagttataattcaatgtattgtcgaatacggtttttgaatatttataatgatattcagatccgctagcttcatttctagtacttagaaaacttggactaaatgaattgttttcagtaaattgtaaattacctgataagctggaacggaagcggaatcctttccagatatcaacttctccatatacggttcccatgatacggtaaatattattatggttcttcttataggtgttagctaccggattggcactgccacttgataaatcaaattcaccattgtcattgtatataggaaggtcaggacggaaaccttgcgcactaaatagtgaagtgtttgcattatcttggtctgtatagctcatattggcattaataccaaaacggaggataggcagcacattcatttctgtagacacacgtgcgttataccggctcaggtcacctcctttgaccataccttgctgatcgaatactgataatgaaataaggtatttggatactttactgcctccgcttacagtcaagtcggcattatggcggatggcagtttgtttcacttcgtcaaaccagttggtattagcactacctaatgcagtggaattaggctcaagaatttctaatgcatattggttggacggatcatataccaaggtttctttagcgaagcggcgtactgtttcgcgccattcgtcaccatataaaatacggaaattcttgatctggacatcagtggttacattataattgaagttgacggtgggtttggaaccttctactccttttttggtggtaacgataactacaccatttgcagcacgagaaccatagatagcagccgcagaagcatctttcagtacgtccatagactgaatgtcattgggcgaaattgcatccagcatactgggatcttctacaggaactccatcgatcacatacaagggttcattggaaccggtcaatgaggtagcaccacgcacacgcacgcggactgtttcgcccggtacaccggtattttgtgatacctgtacaccagcggccaagttttgaagcatggaagttacattaggagtatttaattgacttaattgttttaaccctactgaagccacagaaccggtcaaatcttttacagaagaagtaccataacctactacgaccacttcatccagattggttacttcgctttccatttttatattgaagacatgtctgttaccaattttctccttaaccgtctgcataccgataaagctgatcatcagttcgtcgtttttagtattttcgggataagacaacatgaactgcccatccatattggctacagtaccgaaagttgtaccttggatgacaatagaagctccaatgaccggttcacccgtatcatctttgataactccggtaatcgttctgcgtttggcatttctgtcaatcggtaatattaacacataattgttttctaccaactcataacgcatacctgcctggctacaaatcactgaaagtgcttgctccagaggttctttgtttaatgttagtttcaaaggtacattgtttaaagttgcatcttcgtacatgatattaatgccggtttgctttttgaccatgttaagggcctctttcacactgatgttttcacttttgatagtgactgtcttgtcagctgatacatttgcaaacacagcgttgaatgtgcagaatatgcacattagcattactaaaaacctcatttttggaggtttagctactaaacgcttccaaagctcgtttcttttcataaaactcaaataacttatttaataatttagaatgttcctgttatacagggcttgattattgtttttttactaatatggtttctccctttttctcaaacttgacatcggatacacgatgaatgatgtctagtgcaaagtccaaaggcttgttacggaaaataactccggtgaatttcatggtttctaattccttggatgctatttgaatatctacattatagcatcgggacagacgggctatcagcaaaggaaatggcattgcgtcaaactccatagcaccctcagtccatgaaatatagaattcagtatctactttggaaacttttgattgtgcagaagagtaatgttcgcctggtagtagataatattcacctgatggagcatttacctttaattttccttcaattaaggttactgataattcttcatcgggataagccgagatattgaaagttgttcctaatacataaatagcatggtcgtgtgtttttattatgaaagggcgggcttcatcgtgtgttacctcaaacatggcctctccttccaaagtgacttctcgggtatctccgaattgaaccggaaaatcaatatgagagtccgcattcatttttacttttgtgccatcagctaatactattgcgtactccgaaccttttggcactataattttattctgtaataattcagtatccagtttgggtttgtggggggaatcactttcttgaggaaatatgatttctccattgttgatatgacttccattgatttcccgttggttttcatagaggggaactacagaatggtttgcttgtacccaggtggctttaggagtttctgtgtttttgggaagaggggattgttgtggctgttcgttttgggcaatggcaggtactggcttctggccattgaaatataaaatggaggtaattcctattagtattgctattgcagcggccgaggaataaatagcgatacggcgatgaatagtatgggaccggttacaacggtgttgaatagacttccatgaggcttctttatcaaactgatgtaataagttaagttggttgtttacatggtggagtgaaagtaacttcacaaagatttctctatgcgatgcgtcttcttcaatccatagctttaattcttccaattcctgctcgttaagctgatgggacaggtatttttgaattagtgtttccgttttactcttttgcataattgttgtacagtttaacagaagtatcacaaatacgcaaaatgggtgacaaaaatctgaataaatttataaattaaataagattagaatttctatcatattgaaacgacgcaacatttttagtgcgcgtgatagatgggtttttactgtatttacggaaatatggagctcttcagctacttctttgtactttttatcttccagaacaattttgactagaacattgtactcttgttctggcaatttttttaattcagtcagtagctggtttcttttttgcaatagttcttcctcatcataaaagtcatcgataggagaataagattcttcttccatttcgtctaaagaaaagtaacgttctcgctgcacttttgtcagtgaagagaaacggacggcattgaacaaccatgcgtgcagattggaggaaatggtggtatgtgagtttttgtcccaaaaactgacaaatagattctgtacaatatcttctgaagtttccgtagagcctgtgaattgtacagagtagaggcataaagggagataataagtatcatacagtagacgaaaggccttttctttgttttcagcaaagagagctagtatcctttcgtctacttcattatatctattgtattttcttgcattattgttcatggatgccttttgcggcacaaaattaggaatttaaccgacacgatatacgactttcaccgattaaaaatgcaaaaagtacaatgtattatgaatattttctttatttttcaattctgaaccagtcagcgtctgtccatcctccgtcattggttacaatagcggggcgcgtacagaagatacctaccttggctcctatccatttaccttcttttacttggaaagtttctcctaatggctggaatttcttgccgtccgtactgtaactgaggttacatttcactaataagtcgtgaccgccttcactggctttaatcttgtctccttttgcagaaaatttagcgcgaagatagattgtgccgccttttaagggaacggaagcatttactttttcagtagccccccgatcggctttcaggcactccacttgtgacaggacaagtccgttgtctgtgttttcaacaactaatccggcataatccattcccattacaaccagtcccgtacgttcacctttatatttttctgtcggcttgaaagtaagcttggtggtggcagtaaaattgggagccggggttttttgtagcatcagattagaaacattccataaacttttataatcttcgggaactgggtaggagtatagacgtacaaatccttctcctccgttgaaataagcccatttttcattgatgttagcctgccattgccattgaggagacaatgtataaccatcaaactcgtcactttcttgcggggtacaaataggatagttcttacctacattaggctttttataagtcagaacaggttcaccacaaccatcgccgtctttatcaacacctataacgggccagtcatcaacccatttcataggttgcaggtggactaagcgtccgtaagctcctacgtcttggaagtgcatgaaccagtcttctcctgtaggggtgtctacccaaccgccttgatgaggtccgttgacgggagagttgccttgcgctaatactgttttccattcgtatggaccgtatacgttttttgagcgaagtacgacttgccatcctgtaggaacgccgcctgccggatggaagatgtaatagtatccattacgtttatagaatttgggcccttcacaagtttgatgtgcttcatgaccatcgaaaatgatacgggattgtgtgatagctttacttgcatcagcacttagctcacaaattgtaattacacttttcagtccggcccggcttcctgcataagcgtgaaccagatatacacgaccgtcatcatcccataatggggtcgtgtcgatgatgccctttccagctttcaccaaaactggctcgctccagggacctttcggatctttggctttcaccatgaatactccttggtccgggtcaccccagaatatatagaattcaccgttatggtgacggatactgggtgcccatacacggttgccatgttcaggacggacatcggtaacagggggcagtgcgtagggtacagccgcacctatgatagtccagttgacaaggtctttggagtgtaatatttgtaaaccgggcagacagttgaaactggatgaggtcaaataataatcgtttcctacacggcaaatgtccggatcggagtaatccgcatacaggactggatttttgtaggttccattgccttgatcggccacccaggcttgggatacataattctgtgcgggagcagataaaaaacagcttcctagcagacagagagtgattagtcgtttcatggttttagattttttatttaatcgtaattttgcaaggatgttccaattcttttctccattggggaagataattgaaccagtctttcatatctttaaatccgaaactttctttttttgaggtgaaagtaacgtaatagtggaaatgctgttgccccggtgcttgtaaggtatataagtagtttgatccgtcttgtacttctttaccgatatatttaggaatgaaagttcccatacctgttgtttccttcacatagcctatggtgtctgtgacaggccagtcggttccccagcttccagtcagtcctttatggtcgctcatgtgacctccttctttcagaatctgtacacctgctgcaaagacttcctgtttaagcggacggtcaaacaggacatctaccttcatgtctcgatgaccgccatagatggtatatcgattgatcatgttcaaatcgtttccttgatattcccaaccgatgacttctgcttcgacgatggcacgtacaggtccggaggctagtacacgttccgtgcggtttactactggttttatgtgggtcgcttcagtaccattccaaccttttaatgcacctacaccaccactattgtaaacacgtagcgcatcatctccgtagccgttggcacgttgcgctttggtagggtagaaacaagtctcttttatttccagtcttttatttactttgctatatggatctaccgtctgtttttcattgaaatagatacgataggcaactaattcactctctatagccggtccgtgatggtaaacaaaactatatacattctcggttcctgccgctgaaaatcccgtaatattggcgaatttgttgttatgtccgtaagctttcatttgggcataagtacgtgccggatagtttttttcacttttttctgaagagagaattacacggaaacttttattgcttttggctggcatatcgataaggaaagccagttcgtcagcacgtgcgtcaccgttcagatcgtctagttgggacggaatttctttattaccttcccatacagtggcggatttgatgttgaaacctgctttcaggttatttaaatctatcactaccggttcatcggtcttattttgagtccattcattactgacttctacggtcagtgtcttttcgcctttttgtgcaaaagagttggtaaagcatcctgctaataatgtgaggacaataattgagcgctttttcataatgatgtatagtttattattttaagcacggatcatacggattacacagtgttagtatgaaaaccgtgtttatccgtgcaatccgtgctttactatttttataaattaagtggagaaatgcactaatgggtgtaagaattagaagttgagttcttctccttgtgccccgatttcagcatgattctttccgtctatcattacattggaaacattttgcatcttcaagttctttccactttttaataactctattttgatatttttcatattaacttcgtcggcttcgcttaatactacaccttctttagcattagatacgatgatattctccatattgatattcttgattctcatctcaggcaaaccattgaagaacacagccctgcctgctccgttacaggttacatctttgataaagatattacggaatatcggagtttcttctgttacaggagggatggtagtttctgctttcttttcatcctgattagggtcttcaccacgaccttttccaccatagtataaattgaatattaatgcttcgttcggaatattaatcatgttgatattgctgatgtagatattctctaccaatccgccacgcccacgattacttttaaagcgtaagccaacatctgtacccatgaaagtacaattgtctacatatatgttgtttacgcctcctgacatctcactacctacaacaaaacctccatgtccatgtaatacggtgttgttcataacgatgacattttgacaaggttcaccgcgtttgcgcccttgttcgtcctttcctgactttatacagataccatcatctcctgcatcaaatgagttgttgataatcaatgctttattacatgattccaaatcaagagcatctccgttttgtgagtaccaaggattagaaactgtaactttattaattgtaatattttcacatgatagcggatgtaagcaccaactaggtgaatttttgaatgtcgctccttccagcaataccttattacatttgatgaaacttagcaatacaggacgtaaccaatcgcgcatgtagtcccagtcagaatcggtaagttctccacgaggtacattgaagttgtcttttgataggatagcacctttcaatgcaccttcactgggataccagattcttccgtcggcatctactacaccaccagaggcgatcaattttttccattgaccttcagtcagtttatctttcttggtcggacgccatgtgtctccattaccatcaaatactccgtgacctgtaatcgctatattttcagcattacgtgctgaaataggagactggcaacgacgggtttccaaaccttcaaaagacgtgtttataatgggatatagtgaatggtctgcactgaataatactaatgcattcttttctgtatatagattcacattgctcaatagttcgatgggaccggtcaaccacaagccttcagggataatgactttaccaccgcctttggcattaacctgttggattgcatcattaatagcctttgtgtttaaagtaataccgtctggtttggcaccgaaatctatgatgtttaccgaatagtctgggaaagtaggttgttcaactttatccatcttgaaagggagacttgtatagatggcgggatctatgatatcttctacaatagtcgtagacggacaattattacatccggtcaaaagggggattaaacatgtggcaggaagtaatagaatcttctttattaaagtagtcattggtattatatatgtttaagattaataattatctagttgattgttgctttaagaagtcttatcactctcccgtaaaagaccctcacgggctatttacgggagtagcaataatgtttcatgttaacctaattctaaccttaaataaatattatgaaaaaacctcttaatttgatggcaaatataactgaaagaattgtcctttatgtgcactatttgatagaataagtggattttttgttaaattctcatttagctgaaaccttaaatggtaaaaattagttttataattgcattatttcttcatttgtgtgcaaaaaaagctatgattaatttatttgtttgtatctttgcaaactaatttaacaataaagaaggtatgagttacaatttgttgaaaggaaaaagaggtattatttttggtgcattgaacgaacagtctatcgcatggaaagttgctgaaaaggctgtagaagaaggtgcgtccattacattgtccaatactccggtagctgtccgcatgggagaagtttctgctttagctgagaaactgaattgtgaggtaattccagcagatgcaaccagcgttgaagatttggagaatgttttcaaacgttcgatggaaatattaggtggaaaaatagatttcgttcttcattctatcggtatgtctcctaacgttcgtaagaaacgtacttatgatgacctcgattatgatatgttgagcaagactttggatatatctgccgtttcgttccacaaaatgattcaagctgctaaaaagctggatgctattgcagagtatggttcaattctggcattgagttatgttgctgcgcaacgtacattctatggatataatgatatggcggatgcaaaagcattgcttgaatctatcgcgcgcagttttggttacatttatggtcgtgaacatcatgtgcgtgtgaataccatatctcagtcgccgactatgactactgccggctcaggtgtgaaaggtatggataaactgtttgattttgctaaccgtatgtcaccattaggcaatgcttcggcagacgaatgtgcagattactgtattgtaatgttctctgacctgactcgcaaagtgactatgcagaatttatatcacgatggaggcttctccagtgtaggtatgagtttgcgtgccatggcaacttatgaaaaaggtttggacgaatataaagacgaaaacggaaatatcatttacggataagaaatagatgatacgcaaaattatattcatattagtgggatgtcttgttgctctttcctcctgtcaatgggatgggaagagtggcaatactgctgatgtggatgtaagagttgcccgttatgatcgtttgcagtatgagtatgttacgatgaatagtttctcggcactgcaaaaaatgaatacggactatcctcaggttaccaagctgttgatagaagatgtattggcgataggtgaggtggatgacatgaagattaacgaccggatgttggaatattattcggattctaccttattgactttgatgcacgatgccgaagagaaatttaaggatcttagttgggttgaggaaaaactgactaaaggtttcaaacgtttgaagaaagaggttcctgcattgtttgtacctcatttttatgctcaaatagctgcgctgaatcagtcggttgtagttggggatagtattttgggctttagtattgataagtatatgggggcggattatcctttatataaacgcttctattatgactatcaatgtcgcagtatggagcctgatcgtattgttccggattgttttaccttttatttgctgagtcagtatcctttgccatggcagcctggtcgtactttattagatatgattatgcatcgtggaaagataaattggatagtggctcatattttagggtatgaatcttttgagaaagagatgggatatagtgaggatgaggctgagtggtgcaggaagaacaaaataagtctgtggaagacaatggttgaaaatggtcatttatatgctaccgatcctcttgttgtacgtacttatatacgcaaggatccctttatttctattatgggtgagaaaactcctgcaagcattggagtatggatggggattttgctgattgatgaatatatgaaaaagcatcctgatatgacaataaaggatttgttggctaaaacagattatcatcagatgttagctgaaacagatttcaaaccttgatattttgactgattagtagtatgatggaagttgctttgtatctattgcctgtcacattgggcgaaactcctgtggaaaatgtgttacctgtgtataataaagaggtcattctcggcatcaaacattttattgtagaagatgtacgctcggcacgtcgctttttgaaaaaggtagatcgtgggattgacatagatgcattgactttttatccattgaacaaacatacttctcctgaagatatttccggttatctgaaacctttgttagccggacagtccatgggagttatttctgaagccggttgtccggctgttgccgatcctggagcggatgtggttgctattgctcagcgtaagaatcttaaagtggtgcctttggtaggaccttcctctattattatgtctgttatggggtcgggttttaatggacaaagttttgcttttcatggttatttgcctattgagtctggtgagcgtgcaaaacgtattaaggtattggagcagcgtgtttatgcagaagatcagacgcagctttttattgaaactccttatcgtaataataagatggtggaagatattcttaagaattgccgtccgcaaaccaaactttgtattgctgccaatattacgtgtgaaggagaatatatcaagactaagacaataaaggagtggcaggggaaattgccggacttatcgaagattccctgcatattcttgatttataagtagtgcgataacagatattcatttaaattcctcccacatttgtgccactatgttcagatgatctacttcttcttttagaaaagaactatattgggcagaattcatttctatttcttcgggagtaacaaatttccctccagtaaaatgtatctgttcttcgtcatttaaaggaagaatatatagcatgatgattttttttactccattggtttcttttaccaaatgtttcagactgaagcgtggctccggttgtccggtaatatggttgctatatttattttctacttctttggcatatttatccgtatctgtcttgcaggcataaatgtagtcttccataggtatgtccaacttgccgggttcttcaccttgataactgcggggggcaacataaatctttccattgcaaataggggcgatacgtaagaaaggcatttttttataagttaaactgattgttttcacaaaagcatgattgacaataatgcaaatgacatatatcaaaggagggatgatgtgggtcatagcgtaaagggtattataagaaagtggactgaaaaataaataaattatacaggaagcaaacaagtgaatgccggataaaacagctataacctgtgtggcccaacagttcagaatagatatcttataatgaaagtaggagaatagttttgcataaaaattggggaccatgaggtagagtagtgaaaaacagagtatcagtatttctaacgtaatgggaactgttcggtccggaataagcatatctccgcttataccttttatgatggatgcaatgattaatgccaaagttccatgtagtaatactaggtttggctgataaacaggaggtttgacaagtctgtataggatataaataatgctagccaaactacagacatacaaaacagctgcatcttgaaagaaaatgcagaaaatcatacatacgatggttggaattaaccctgtagacatgattaaattcttgtattccagtaacgatttcattctctctatctctatttatatctttataacaaaaaagatataaagttggtttactcgttaccctttaaattttatatgtttttctgcatgataggaggaacgtaccaaaggtgcgctttccacttctcggaatcctttctttaatccaattgttctatactgtttgaattgatcgggggtaatatattccgctaccggataatggcggtgggtgggttgtagatattggccaatagtaagtatcttgcaaccttgtgccaataaatcgtccatgacttcttctacttcttccggccgttctcccaaacctaccataataccggatttagctgtaataccattattggctatttgtttgatgacctttaaactggttgcatagttggctgcacttcgtaccaagggactgatgcggcgtacggtttccatattgtgtgaaatgatgtctggtttggcgtcaatgactagctgaatcagttcgcttcttccttgaaaatcaggaattaaaacttcggacgtggtttccggattcaatcgtttgatttctgaaatcgttttagcccaatgggcagcacccaaatcatttagatcatcacggtctacagaagtaataacggcatgggataatttcatgagttgaatggactctgctacatgggtcggttcttcagggtctaacggaagaggtcgtccggtctgtgtgttgcaaaatttgcaggaacgggtacaaatttcgccacctatcataaaagtggcagtaccttttccccagcattctcccatattgggacatcgtccgctactacaaatggtatgtagtttatgagaatctacaatatgtttggtctcggtatatcgagcgtttgcccctatgcttattttaagccagtctggttttttaacatgattcatgatgatattagatttataattcaccacagattataccaatgtaaattgttctcattcggtttttatgtaaaactgtataatctgtgatgaatggtttttattttaaattatcaataaagaaattggctacgcgagtcagtaaatgtctagttgtgttgcctccactgattccatggttgcggttggtatagatttgcatgtcaaattgcttgtcggcctgtaccaatgcttcactatattctgcgttgttacgtaagtgtacattatcatctgctgtgccgtggatcagcaacaattcaccgttcagtttgttggcacggttaatagcagatgcagcattgtaaccttccatgttttctttgggggtacgcatgaagcgctctgtatataccgaatcgtagaaacgccagtctgtaggagctgcaacagcgactcctgctttgaatatcggtgttccttcactcatggacattaatgtattgtaacctccatagctccatccccatataccgatacggttaccatccacgtaaggtagtgtacttaagtatttggcggcttctacttgatctttcgattcttttactcctaagttcaagtaggtacatttttcaaaatcagaaccccggccaccagttccgcgtccgtctacacaagccatgatgaaaccttgaccggccatataagcttcgaacatgccgccatctctacgggctccaattccccatttgtctgcaacttcttgtgaacccggtccactgtattggtgcatgataacaggatattttttgtttggattgaaatttgcgggtttcattatccaaccattcaattccacaccgtcattggtcttgaaactaaatagttctttacttggcatattcagacgtgaaacttggtgtttcaatttgttattatctactaaggttgccaactctttaccattattgtcattaagggtaatgacaggaggggtgttgatattagagaaagtattgatgtaatacttcatattgttactgaaaatagctttatgagttccttcctgcttggacagtttggtctttttacctttgccatccactttgtagatagcggtgcgtagcggactgccttcattgctctcaaaatagaatgtgttggtagcttcatcccatcccaggaaatctttcacttcgaagtttccttttgtgagttgcttaaccaggtttcctccgctagtgtaaagatagagatggttataaccgtctttttcactcatcaccacaaaattttttggatagaaaacgatgttggagtatgcttcttctttaatgtattggggagcttcatcacgtaccatcagtttacacaatgtacttcgtggattggcaaaatagaggtcgaaacggttttgatgacggttcaaagtcatgattgccaacgcattctcatcatccgtaaacttgatgcgaggaatataaccgtctgcgtctagaggcaagtccatcttgcgggttaccttactttttatatcaaaagtatgaacggttactttggagttgtcaattcctggcatagggtatttgtattcatattctcccggataagtgctgaatttctctaatgcgggaaccatacctttgtatagtggaaaagaatacataggtacttgactctcatcaaaacggatataggcaagcatctggctgtctgcactgaagtcgaaagcacggttgaaaccgaattcctcctcatatacccagtcgggaataccatttagtacttcgttgaatttgccgtctttggttacttgtgattcactgttgccaaacaataattttaccagatagatgttattatcacgtacaaaagctatctgattgccatccggtgagaataaaggaacctgttgtgggccgttttctgagagcggttccattttattgttttttacgttgaaaatataataattggcagtaaacgaacgacgataaatcggtttggtatcagtctgtattagaatcagtttctcatcgggtgacatgatatagtcatcaaatgacttgatgctacagtcacgggccgtatttacatcgaagatggtacctgtctctttgccggtcttgaaagaatactgcatgatttttttgccatcagtactcatttgggtgtaatgttctccatccaacatcggtttgatacctctgattccttcggcacgatacgttctgtttgctacgtcttgcaagcttacttgttgggctccgactgtcagcaggcagaagaataaaataataaatatgcttaattttctcataatagataaattctttaaatgataatcaaagacaaaggtaaaacttttgtttgaaaatacgtatctttgtcccgcaaaataagttcatgaacagagagatgctttataacgacttatccggctttttagccatgcactttccttgcaaagtgcagaagatttctattaatgccggatttacttgtcctaaccgtgacggctcggtaggatacggaggttgcacttattgtaataatcaaacatttaatccggcctattgccatacgggaaagtctgttactcagcagttggaagaaggaaagcggttctttgtacgtaaatacccggaaatgaaatatctggcctattttcaggcttataccaatacgtatggggaactggaagagttgaaaagaaaatacgaagaggcgctgatggtagaggatgtggtagggctggtgatagggactcgtccggactgtatgccgatatcattactggattatttggaagagcttggtaaacacatttttgtattagtggagtatggcattgaaagtacggatgatgaaacgttgcgcaggataaaccggggacatacttttgccgtttctgcagaggctgttcggaagactgcagagagagggattttggtaggagggcatataatccttggtttgcccggagaaaaaagagaaatgttaatcggacaggccggagtactttcacaattacctctgactactttaaagctgcatcagttacaacttattaaaggtacgcgtatggcgagtgaatatgtgaaagatcctgaagctttccatctttatacagctgatgaatatgttgatttagtcattgattatatagaacatcttcgtccggacatcgtactggagcgttttgtttcccaatcacccaaagaattgttgatagctcctgattggggattgaaaaattatgaatttacgaataaggtgaaaaagcggatgagagaaaaagatgcctggcaaggcaaatactataaatattaaaagaaggaaacagatatggaaatcaaaggaaaagtacattatgtgggagtgaatgaccgtaacaaggctttgtttgagaacttgtggccgttaccttacggtgtgtcttataactcttatttgattgacgacgagatggtcgccttggtggatacagtagatgtatgctattttgaggtttatttaaagaaaattcgtagtattatcggtgataaacctatcaattatttgattataaatcatatggaaccagaccattccggttctattagtttgatcaagcaatattatcctaacattgtgattgtcggtaataagaagactttcgaaatgattgaaggattttatggtgtaggcggtgagcgttatgtagtgggtgaaggagattttttagctttgggacaccacagactgcgtttttcattgattccaatggttcactggcccgaaacgatggttacttttgatgaaacggaaggtattttgttttccggtgacgctttcggttgttttggtgcattgaatggtggtgtggttgatacaaatattaatacagatatttattggaatgaaatggtgcgctattattctaatattgtaggcaaatatggtgcgccggtacagaaggccttacagaaattgcaaaacttgaaaataacgactgtttgttctactcatggtccggtatggacggaagaaattcctcgcgtggtacgtatttatgaccgtttgagtcgttatgaggctgaagaaggggttgtaatagcttatggctcgatgtatggtaatacagaagaagtggcagaagttattgcagaagaactgagcaagcagggaattcgtaatatcgtgatgcataatgtttctcataccagtcattcttttattattgcggatgtattcaaatataaaggactgattgtgggatgccccacttataatactcagatgtatccggaaatggaagctctgctgagcaagctggcttctcgcgagataaagggacgttatctgggatattttggctcatttacatgggctagcgctgctgtgaagaaaattgcagagtttaatgataagttgaaatttgagcctgtcggaaatcctgtagaaatgaaacatagcatgaaggccgaaactaacactcaggcaaaggagttggctaaggctatggctgatcgtttgaaagcggatagaaaataaatcttgtgatagaacataaatgacgcaaatgacacatgattggtaagatcaagcttgtgacaattgcgtcattcgtgttctaaaaatttctgacgttaggcttgatgtacagtaagctgcgggaatgggaagttaattccttctttattaaaagtagtataaacagtctgattcatactgaaaaatacgttccaataatccgaactattcacccatacgcggatttttatatttacactgctggcagcaagttctcctaattcaataaaagggggcggactggtaagaatacgtttatcattggctatgatttcgcgcaatactttttctactttattatagtcttctccgtagtccacgccaaaattccattctatacggcgggtgtccagtttactgtaatttgtaatgaccccactactcatggctccattaggtacatatatcatcttgttgtctgcagtgataagaatagtatgaaaaatctgtatttcttttactgttcccgaggcaccggtagaagcttcgataaagtcccccactttataaggcctgaacaataagataatcagtcctccggcaaaattttgtaagttaccagacagtgccataccgatggcaacaccggcagaagcgagaagtgcggcgaatcctgtcagttcgatacctaatttccctatcacagcaagaatcagcatgatgagcagtaagatattcaccatactctttaggaatgactggatactcgggtccacttttcttttttccaaaatacgtgcaaaaagtctgttcagccaatttatgaggaactttccgattataaaaataataagtgctcctaatactctttctcctaattgaatgccggagtcgatcagtttctctaatgcattggttaattgaatacttgtttcagatgctaataacatgataaatttactttaatttgacatttctaatatataaaacaattcagattaaaaatcgttcagaatacctttgccttggcgtacaatttctgcttctccgcttgtacagttcacaatggtagaaggttctatgtttccgatacctccgtcaataattagttctacctctttcccgaatttttcttctattagttctggagtggtaatatattctatgtcttcaccatctttcagaggcaacgtggtggtcatgatcggtgcttttagtatatggcatatttctctgatgatgttgttgtcaggtacgcgtatacctacttctttacggttcttgaatattttgggcagacggtttcccgtattcaggataaaagtaaacggtccgggaagatttcgtttcattagcttgaatgtgctgttatctactttggcatattcgctgatattgcttaagtcgtaacagataatggataaattgtttttacgtggatcaatgtttttcagtttgcagatacgttctattgcacgttctttcaggccatgacatcctatggcatacatcgtatcggtagggtaaataattaacccgccctcttccaatatccggattacttcttccagatctttgggattattattcttattataaagtcttaaaagcatgttattttaatttttagaatttttttcacgcaagcgttccgcaatagcccattgtagggcggcttcctcttcttttcctactttcatcaatacgtctccgaaatattcatgggcctttggatgttccggttttaaagaaacagcccggtcaaaatctcccaaagctccttctatattatctagtgctagtctgttttttcctcgattataaatagctttgaataaagcgggactaaggcgtactgcttcattcagacaaacttcggcttcgtaatattccttgtcattatgtaatgtgatacctttacgcacccaagcgtccgtataagaaggattcaattcaatcgctttgtcataattggcaatagcagcacgtgaatcatgtgcttggataatacattcatttcccattaaataatattcgcgggcatatttttcaagatttttacgttgtacatggaattggtcttttagccgtttgttttcgaccttcaaattgttgatgattcccagtttcttacgtataaatcttttaatcaaaggtttttcgatgtcataacgtgaatggatggcaagaaagaattgttctagaaatctttcaaaatcacctttgtcgaagtgttgtactgcttctacatattgtacatcagcttgtgcctgcttcaatgctttttcaatggactggcggttgttgaatcgttgagagaactttactatttccggacggacaaagatatctccacgtgtaatttgcttttttagttggatgccgtttagtgaagtacagcggctcaatgctacgtaggcttgtccaccggcaaacacccctcctgtaaaatcaataacgaccctgctgaaagtcaatccttggcttttgtgtatagtgatggcccatgccaaacggataggatattgtataaatactcctaactcttcttcttctatttttttttctagttcattgtacctatatcgtatattgcgccaactgtcttttttaacgtcaaattcttgcccgtcttctgtgataacatataatgtatcctcttcgtctatacctgaaatggtgccaatcgtaccgttcacccaacggcggtcgtaatcgttttttataaaaataatttgtgctcctggttttacttccagttccatttgggtgggaaggctgctttctggaaactctccatgtatctcaccggtcagaatcgttgattctccaggcagttcagataatttcttttcattgataaagtctacggtatctctccgggtagcaagtgtgatatacatatcactttcattttcttctatttgagtgttgtaacgggtgtttagtagttgtaagtcagctgctccggcagtattggtccggatatgatccaatacattaacaaaaactttgtccgactggcggtatacttttgtcagttctatggataccaactccatttcctgaaagactcgtgccgaaaagaaataaggggtgggatagaagcggttgattatctcacgttcgtcatttttaatgactggttcaagctgaaaaatatctcctaccagcaaaatttgtttgcctccgaatggttcacgcatattttgtgaatatacccgcaatattttgtctataaagtcaataatgtctgcccgaaccatggaaatttcatcgatgatcactaattctatttcttttatcagtttgcgatgggcggaagtatatcttagaaagctatgtaactttccatctttcaaactgaatttaggatcatccggcaaaagtggatagaatggtaatttaaaaaaactatgcagtgtgcttccaccggcattgatagctgcgatacctgtgggagccagtactatatgtttctttttggttacttcgcagacatattttagaaaagtagatttacctgtacccgcctttccagtgaggaatactgactgacgtgtatattggataagattcaaggcatcttgaaactctttattatgggtatctacttgcatttgtccatacgtttaaaaatgaatgaacaaagatagtggaaatcccgtaaaagggcataaaaaagacggttaaataaccgtccttttttatagtcctacagggtgttgctctgtattggttctaatttactttgtttcgttcaacataacgtaaccccaaatcataggatcagcgttagcgattttgtgaaaaatgttttttacctttttcataatgttatcctttcttttttaattaatacctaaaaacactcataaatagcaggcatacctcccggttagccttctttaaacaatctttctttttaccttagtagctactaaaaaatatctttttatgttttacaacacaaagataaagcttttgttcgttataatatgtattttgcagcatatttttaatcaatattccaattttattgatttaggtcaacaaagtaggagcttcttgttgcattttggtgaatattttgttcgtttctgccgtataacatataaatcagtttgcttacctcaagaaatattgtttgatttgtgatatcataataatatcaaaataaatcattatggaaacaaaagaaatgtcttacaatgagctggtaatcaatggatttatggctttgttctttaacttggttatgttgcctgcactagtattcctgaactttttgatttttggacaactaccttggttatctattcctgttttatttgtgctggtattgttgtttgtgctgatgcttccgggatatttttctcaagaacctaatgaggcacgtgtaatggtgtttttcggtgaatataaaggcacttttaaaaacacaggcttcttttgggtaaaccctttcatgaacaagaaaaagttgtctcttcgcgcccgtaatctggatgtggagccgataaaggtgaatgataagattggtaatcctattctgatagggctggttttggtttggaaattgaaagatacctataaggcgatgtttgagattgatgcgcagacgatggcggacagtaaagggactgggacggcaagtgttagcgtggcagggcgtatgaatgcttttgaagattttgtacgtgtgcagagtgatgcggctcttcgccaggtggccggacagtatgcttacgatgacaatgagcatgatactaatgaactgaccttgcgtggcggaggtgaagaaattaatgaccagctggaacgtcagcttaatgagcgtctggctatggccggtatggaaatagtagaggccagaatcaattatttggcttatgccccagagattgcagcggtgatgcttcgtcgtcagcaggcaagtgctattattaccgcgcgcgaaaaaatagtggaaggggctgtttctatggttaagatggctttggataaattagccgaggatggaattgtagaactggatgaagaaaagaaagccgctatggtcagtaatttgttggtagtgctttgtgcggacgagccagcacagccggtaattaattccggaacgttgaatcattaatgtaggaaatggcaaagaaagagatgataaaaagctttgtgctcagagtggacgcagaaactatggaagctatcgagaaatgggcggcagatgaattccgttctacgaatggacagcttcaatggattatagcggaagctttgcgcaagagtggcagaatgaagaaaaagaagacaataatcaaaaaagaagaaacagaatgatacagttattttgattgtttatactgttttgggtctgtaaaaagggcatcaatatcgataaaacaaattatttttcttattttcatagggtattttaatcctgggtgatcttataagtagaaacaggattagtatttacttttttaataccttaatgaatatgagagcgcataaaaaacaatttattgaatggacactgctcattgttctttggctgagtgccattccgggatggagccaagaggaggtaccgtttgctgaagagaatacttatattacagtcagcggtgtagtaaaggacaaacaaaatagaaggactttagagtatgtcaatgtatctgttccgggcagcagtgtggggacggtgacaaatgcggatggtgaattttctttgaagatagaagatgcggagatggtttttgctttagaaatttcacatatcggttatcataacaatagagtacgtttagataaagaacatttatcggatttaaagatttaccttacccctcatgccaatatgttgaatgagattgtggtttatgcccacaaccctcgttttatagtggaagaggccattcgcaagattcctgtcaattacagtaataaaaacaatatgcttaccggtttttacagggaaactgttcagaaagggcgtcgttatatcaatatttcggaagctattattgatgtttacaagacttcttatgaggatatgacaactactcgagaccgggtacaggttttgaagggacgtcggctgcttagtcagagagccagtgatacgttgggggtgaaactggctggcggtcctactttatctatctatgtggacattgtgaaaaatcaggatgcgttgttggatgtggaaacgttgaactattatgatttctttatggaagaaccggtacagatagacaatcgtcagcaatatgtgatcagtttccgtccccgtgtcgttttgccttatgccttgtattatggcaaattgtatattgatcgtgacaagttgtcgtttactcgtgcggaatttagcttgtctatggataataaagtcaaggcggtacaggctattcttgccaagaaaccttatggcttacgttttaaaccacaggaactttctttccttgttacctataaagatgtggatgggaaaacctttctgaactatatccgtaaccgtattcggtttaagtgtgattggaagcgcaagcttttctctaccggttatactgtgctttcagagatggtggcaacggatagggaggaaaataatgtggcgataattcccggaaagatggcttttcatcagaaagatgctttttatgataaagtggatgaatattggagcgaggatttctggggctcctataatattattgaacctacggaatcattggaaaatgcagtccataagttaaagaaacaatcgcgttaaggcctcggatgaagtttgcatggttgaaaagaattaccaaaaaagaagtggatgctgaatgatttgttaacactgaccaaaataagggagggagatataaaggcgtttgaagatgtgtttcgccgttattattcccctctctgttggtatgccatgagtatcaccggcagtatggaggctgcggaggaaatcgtagaggagttgttttatgggttttggagagatcgggagaggctgccgttgttccgttctatgaaaagctatctttatgttgcggtgcgcaatcagtcttttcaatattgcgagcatctggaggtgagaaacaaatatcgggagtttgttctctcgcggaaggggcggacacaggatagcagtcctcaagaagagatagaataccaggaattaagacatttgatagatactacgcttgctcggatgccggaacgaaggttgcgcatattccggatgcatcgtatggaaggtaaaaagtatgcggaaatagcttcgcagctttctttgtcggtgaagactgtagaggctgagatgacaaaagctcttaaagcattaaaaaaagaaattgagaattatattataaggacatgagtgaaacaaaaagaaataaggaaagagtggatcgggcatggaataaattgtatgaccgtttggatgctgacggacttttgttatcaggccggcaggataggaaacgtttgtctgcatccatgttgtggaagtggggggctgtggctgctatatgggtcggaatatgtgtctttttgactgttacttatcgaaaagtgggcgaatcggtagaagcccaggctttaattatgcaggagaacacggagcaatctactttggtgaccacactcgaggatggatctattgtctatatgggtggggaaacctctttgcaatatcctgaacatttctctatggacaagcgtgaggttagtttgcagggaaacgctctgtttgatgtgaccggtaaccgggaacgtccttttctgattgaaacagaggaggtcagaattgaggtcttgggaacgatgtttcatgtgaagagtgatgtagggagtactttcgaactgtccgtacagcgtggcaaggtcaaagtggcattgaaaaataaaaatcaagagatgtatgtcaatgcaggtgaagcggtgacgcttaaaacacatcaattgcgtttcactgattatagggacgatacccggatagctcattattggaaaagtatgcgtttcaaagacgaatctttgatgaatatccttagagttattaatatgcattcttccggtttgcagcttaagacttctccctccttaggggagcgtcggcttacggttgcattttctggggaagctccggagtctatggcagagcttatctgtttggctatgaatttaaaatatactcgtgaaggtgatataggtgttttatccgaataaagtgggaagatgaatcatattcgtacatatcattattattggcatatcttctttttcagtttgctggtttgcatggcagaatttacgaaagcggcggatagagatgtgttggagcgagtcatttatcttgctaagagtaagggtactgtctatactttactgggcaaggtgtccgaacagtctggttttctttttgtttatgacagcaaggtggtggacaatgatcgtatggtgaagttgggggcaggacagcgcactattcgtcaggctgtttacgaaattatcggtcggcaggatatcagtctgcgcattgtggagaatcatattttgatcaatcagttgcaggtgcaatgtccggttgttaccacttctaaagatactttggcctattttactttagagggcaaattgcaggataatcagtcaggggctcccattgcttacggcacggtaggggtagtcggtacttctataggcagtattaccaatcaggatggcgaattccgtttacgattgcccgattcgttgagacagggtcgcatcggggtttctcatgtggggtatgtgggacaggagatggatatgtctttattagaggctcaacacgcggtgtggtctctggaacctcgggtgattcctattcaagaagtggtgattcgtgctgtcaatcctatacggttgttgcgtgagatgttgaaagctaaaaaaacaaattatgcgtcggttcctgtttatctcactacattttatagggaaggggttcggtataaacaaaaatttcgtaatctgacagaggctgtttttaaaatctacaaaccttcttctttgttgaatcattctcaggatcatgtaaaactattaaaaatgagtcgcatagtcgatagtcaggaacgggatacactgatagccaagatgagtgcgggaattgatgcttgtttgcaactggatattgtcaagaacttgccggattttctgttgcctgacggtaagggtaatgtgtatttttatgcctcctgtgatatgacggtgatagacaatcgtttggttaatgtgatttcctttcggcaaaataaaggaataaaagaacctctttattgtggcgaattatatattgatgctgaaaacaatgcgttggttcaggcacgtcttgaaattaatcctgcttatgtgaggcaagctacggatatgtttatagaacgaaagacacggaagtggaaaataaccgcgcaagaggtggtttataccatttcttacaggcagtggaatggcatttattacatgaatcatattcgtggcgatctctattttaaagtgaaacttaaacggcaatggttcagtgcttcttccttgcatacatggtttgaaatggttacctgtaaggtggatgtagataatgtgacccgtttccagcgtaaagaacggatgcctacacgcactatattttcggatacacattttaaatatgatgctgacttttggggagagtttaatgttattccgtgggaggaagaactgggtactgtcattgaaaagttgtctcctaaaatagaacagatagaatattaaaataaaagttggatacggagcattgtacttagcatcttttgtcatgatatgtgacatagaatgtgttagcctgatgtttgtaagtttgtatattcatcagtctttagtttaaaatcgattcggctgtccggtcaatattttacccgtgtcagaaagcatgcttttacacgtatgtctgcatagggctacacatattgtatgtgcggacttatgcggatgtatgtggaatctcccatataacaactacattaggcctaaaaacaactatgcaaatctgatatagtaataacaatagaagttgttaactaaatcctagtacacatctgtgaaatcattcacttccaaaagataacgagctttcttaaaagtgtcttggtctttttactgctgccgggggggctatcatattccgtggaggtatgcacactttttgcgggaaaaaggcccgagaacgctctattttacattaaattggaatagtctataaaaagaagtatatataattggaagcaagcatgttatacagaaatatgcttcaaaacacagtgagggcatgggttgtaagtgagggtgataatttttactctaactacataagttgtttataatgagtttgttgtacacaaagtgagggcatgagggcataaaggtccgaacttcctaatgagaaagaatgatgcgtcaagaagactttcggaaattgtccgaagaataaaatgatcctttaagagctaaaatccttccctatgattttgcaggtgagccgatgtttatccaatattcattttagtctatcgcgcgcgatatataatatggtgtgtactttttgatattgcaaaatggattatcgaaataaacattatagataatctgtaaatcagttatttataagtataatcataaaaaaaatagaaaaaacaatagatatatttggataaagaaatgaaatcaactacttttgcatccgcttagcaagagaggtaagtttaaaactgacaagatgatttgaataacatagatgaaacaaaaaagttttaaaaaaaagttcgattttttttggtggtttaaaataaacactttatctttgcaaaacatttccgggtaaaacggaaatagacaagaataagagttctttgaaagatttaagataaacaaacaagtagtacaagccattacattggcaatcaatttgttataaagttttattctttttacgacagtccctatattaatcatatatctggagatgttcattatctaacatatttccttaaccctaaaaaaacaatagtaacagttcatgacatcatgtattatagctacttatcaggtttcaaaaaaaaaatatggaaatggttatacattaaatctttaaagagagccgcaaaagtaacttttatttctgaattcgcaagaacgcaagttctaaaagaaataaacctacctttagagaaaactatcgttattcctaatcctatatcaaaaaatatgcattatgtcaaaaaagtattcaactcaaaagagccaattattttacacattggaactatggaacgaaaaaatttaaaaagaaccattaaagcattagaaggaattaaatgtaagttacgaattgtaggtaaaatcaataatgaaatagaaagcctactactccaatataaaataaattactcaaatgtattcaatctttcagatgatgaattaagaaaagaatatgaaacatgtgatatcgtaaatttcccttcaaccttcgaaggtttcggtatgcctattattgaaggacaagttataggaagaattatattaacctctaatgtttctcccatgaaagatatatgcggaaaaggagcatatcttgtaaatccatacagcattaaaagtatcagggaaggatataatgatatactaaataacaaaattttgcgagaacaattaatcgcagaaggtcttaaaaatgtacaaaaatatcaacctgaacaaatagttaaacaatatattaaagtttatcaatcaatttaaggttatgaaaaaaattttgaatattataattatctttctaccatgggctatcagaagaagattactaaatatattttatcattataaaattcatccaaaggccaaaataggattatcatatatttatcctaagcatctgatcatggaagaaggagcatacattggtcatttaaatgtagcaatacatctagaactcattcatatgggaaaagattgtaccataagtcaaaaaaactggattacaggttttcctatagcagataaatctaattttcaagattttcctaacaggaaaccatatttgatcatgggtaaagattctgcaataactaagcaacatttaatagattgtacagacacggtaactataggtgagttaacctcaatcggaggatatggtactcaaatcctatcacattctacatctttacaacacaataaacaaagctgtgctcctataaccattgggcatcactgttttatcggaactcgttctatcattttaccaggttctattctacctaatcaagctgtattaggcgccggagctgtattaaagaaacaattcacagaatcattctctttatatggaggagttccagctaaattcataaaaaaaatggatgaaaactatgctttttttcatagaacatatagaccaaaataaccaatgaaaataatacattatattccaagtatagataggacatctggaggaacaacagcatatatgcagctgttagccaatgaactaggtaaattagtagaattacatatagttagccatgtctcaaataatccagtaaacataggaaattgtcaagttcactatattcctaccttcaaccaatatagaaaaatgaaaagacaatggctatttctgttaaatgaaataaatccagatattgtacacattaattgctgctggatgccaggatgcgcccttacacagaaatggtcacaagaattaaattataaaatagttcttactccacatggaatgctagaaccatggataatcaaacgacattattggacacgcaaaatacctgctcttttattatatcaaaaaaatgctataataaaagcaaattatttacatgctactgcaaatagtgaaaaagaaaatttactaaaaataggttataacaaaaacattgaaattatagctaatgggattgaaatagaaaaaattactttaaagacttcgtggaaaagaagaaaaaagatattatttctatcacgcatacatgtgaagaaaggaattaattttttaattgaatccattgctttattaaaaaatgacttaaaagattatgtaataaacattgccggagaaggtgacgagaattatatcaatgagttaaaacaattaaccatacaactaggaatagctaattatattcattttataggtggtgtatatggtgagcaaaaatggaaattattcaaagaagctgatttatttatattacctacacacagtgaaaattttggaatagtagtagcagaagcactagcttgtggaacccctgttataacgactcaaggtacaccatggaaagaattagaaagtaatcattgtggatggtggacagcgataggaacagaagctactactaaagcattgaaagattttttacaacaaacagaaacacaactcgaacaaatggggagaaatggaagaaaattagtagaagaaaaatattcatcgcaaaaaatggcctatgatatggtaaatctatatagaaaaatattagagcaatgacagaagttcgtttatcttctttcaacacagggaattttaataaaggagcaggatttataaaacaaactctttggtattttgtcaacgcattatttgtacgtgcttcctggaatccttttatgggaataaaagtgttctttctgaaacttttcggtgcaaaaatagggaaaggactagtaataaaaaataatgtgaacataaaattcccttggaaactgacattaggaaatgatgtatggctaggggaaaacgcatggattgataatcttgatgaagtcataataggaaataatgtatgcatttcacaaggggcattattacttaccggaaaccatgattatacactgtcaactttcgattatcgaaatgcctccattataatagaagacggtgcatggattggtgcaaagacagtggtatgtcccggaataaaaattaaatcgcatgcaatactaacagtagggtctactgctacgaaaaatatggaagcatacggaatttatcaaggaaatcctgcactaaaaattcgaacaagaaatattacaagataaaataccgaacattatgaaagtttcaatcattacttcctgctacaaccgggaagccaccattcgtggagcaatagaaagtgtgctggaacaggattatccctacatagaatacattgtggtggacggagcttcgaaagataactcgctggctgtcatcaatgaatataaaaatgggatagatacaattatttccgaaccggataaaggtatgtatgaagcgattaacaaaggaatacgtgcagcaacaggagatattatcggtctgattcactccgacgatttcctgttttcatctcacaccatctccgacatagtgaaaacattcgaggaacaagatgcggatatgatatacggcaacggagtctttgtagattatgacgacaccaaccagatgatacgaaactggataagcggacggtacagtaaagagaatgtaaaaaacggatggctcccactccaccccactgtctatataaagaaggagtgcatggataaatggggactttacgacgaaagttataagatagccgccgactcggatttgctggtgcgctatctgtatgaagccaacctgaaagtatattacctgaacaaatacatcgtgaaaatgagaatgggggggctttctactgatgcaggaaaaagcaaactgaaatgggcggaggacttgagaatgtataaaagtcacggaataaaacccatctcggcgctgaaaggcaaaattctttcaaagattccacagttcattgaagccagactgccgtggagtgaaataccggaagcagaggaagaaagcctgatacaacctgccgccgcaaataaaaaagaatgaaaatacgtttactagttctaaccttgctgattatcggagttcatcagcatatacaagcacaatatatgctgggaactaccggtatgatgaatattcctaccgccgacaggcagaagccgggaacagtgatgttgggaggaaattatctgcccaaacagatgatgcctgcacgattcgactacaacacaggaaattactttgtgagcatcagtttcttttcctttctggaacttgcctatcgggaaactttaataaaaggggactatatatcatccaagcctaaatacaatcagcaggatcgttcctactccatccggctgtgtgtgtggaaagaaggaaagtttctgccaggaatagcactgggagccaatgatccgatagcggataaaggagccaacacttttcaatcttactatggagtgataacgaaaggattccatctgggaggagagcattatctctcagcttctttgggatattatctggaaggcgggaagaacagtaataccaaatggttcggcaataaatacaaaggtgtattcggagggataagctatatacccgctttctgcaaagagttgaagatgatggccgaatatgactcggacggggtgaatgtgggagcagctgtcaggctgtggaaacatttgtccatgcatgcttttacccacgattttacttgcgtatcgggtggtatacgctatgagtgtaccctaatacattgacgcaatgagcaaatatttaatagcaatcctcctttcggcatggagcatctccctccgggcacaagtggccgagaaactacagcaactgggaatggagaacatacaaacggtaacggaggtgaacggcaacacaacgattgcttttgaagacaatgtatatagaggtacttaccggggaataggcaaagccatcgaagcagccatggaaggaatgtacgggggaaatctgcaaatggtggtgttggagcacagtatcccccagctatgcattacgctgagcgataaggtgataaccgaatataaagagaaacagattaccataggggaagtgtaccgacagatgggaatcagttatgataccgatgaagcgatggaggtactgaaaaagacacaccggacactcaattcatcggcagggaaagtagacattgtggtctatccggaagtaaaactggaaaactccagctttgaccgactttatacttactatgtcaacctggctccagccgtagaaatggctttatggaaaggggcggaactgacagcgcaagtggtattcccggtagcgaccaacctaaaaggacaatataagaagatacgtcccggagtgattgcactgtcgcaagagttttgcttcggcaaaggatttttggggcgagtaaccgcaggaaactttaccaacaaccgcatgggggcacaagcggagatgaaataccgcacagcgaatggcagactggaactggaagctatggcaggagctaccgtgcaatctgtgctgaccgacgacgaaggatggtatatcagccggaaactgcggatgaatgccgcactgaaagcatctgtgtatgaacctcgcttcaatttgcaatttgatttgcaagctgcacgttatctatatggggattatggagtaagaggcgactgcacccgccatttcggagaatatgccatcggcgtgtatggaatgtataccgatggggaaataaacggaggattccattttgccatccctctgcccggcaagaagtggagccgtaaccggggggtgcgtgtcaggcaagcggattattttgccatggaatacagtatggaatcctggggcagatatgcggatgaaaaaatgggggaaacttatcgcacccgacctgatgagaaccggagtaaccggtttttccaaccggaatatatacgctatttcctgataaaggaagcaaataaatagattactaatttttaaaaacgaagaaaaatgagaacaagcaagttttttaaaacaggtttgctgctgtttgtagcaagtttggggttaataagctgcggggatgacgacaaagaaccggaaattgtagttgaccctgtaagcgaaaatgtggaatattacattgaaggtaaagtagtagcggataatgccgcactggacggggtcagcgtaacagcgggagaggctaccgcaaccacagacgaaaacggtcaatattcactgacggtaaaagataagaaaacttatacggtgagctttgccaaggagggatatagaactgtttctgacgcatcagtagaaatagctaacaacgctaccaacagaagtctagtaacactgaacgtgactatgagcaaggaaggcgtggctgtagctgttgatcctgaaagtgataaagtgattacagaaaaaggagaaggggaaacagaagatgcccagaccgtattgactattcccgccggtgccgtatcaaccgctaccgatgtaactcttactccgtatctggaagctgttgcaaccgatgtgactccgggcagtaaggaagaagcgattcccatgactaatattgctatcagttccagccaggatgcagccttaaatcaggatgttaccttgtctgtagccaatgctagttccagcgattattattttgacgaagtagaggtatacgaaaagactaacgcacgtgctatcggtgactggaagaaatatgccgacgccgcttttgataaagcgaccaacagctacatagctgccatcaaaaagggaagttcactgaataaggattattctatccgtgtaaagagtgaaaagaatgtcagcgaaaccaagaacgatgaaatattgaaagaagacagctacagtaacgcaggaaatatgagcgctactacttatgatattccttatactgccaaattaggatgggaaatctctgcatccggactggatgaaggcgctctttcattggtgaaagctgccatagccgcacaagaaggtggatcggaaggtgtatacaccgtaaacaagacctttacagcccacgtaagcggtgactatattctgtatttctcttgcaaagccaaatatgtagaaaaagagtacactttctctattgccggtaaaaaggttactgtaaaagttaaacattatctgggagtggaatttgtttataccaaccaaagttcaagtatgcatggtggtggctctataggctaaaacagtcttttcaattaatacaaaatatgagtaaaaaagtagcattgatttcaggtatcacaggtcaggacggttcgttcctggccgagttcctgatagaaaaaggatacgaagtacatggtattctgagacgttcttcttcattcaacaccgcacgtatagaacatctgtatctggacgaatgggtgcgggatatgaagcagaaccgactggtgaacctgcattggggggatatgacggacagcagctcactgatacgcatcatacagtctgtacaacctgacgagatttataatctggccgcacaaagccatgtaaaagtaagcttcgatgtgcccgaatacacagcggaagcggatgcggtaggtacgctgcgtatgctggaggcggtacgtatattgggactggaaaagaaaaccaagatttatcaggcatctacttcggaacttttcggactggtacaggaagttcctcagaaagagacaactcctttctatccccgttctccatacggagtagccaagcaatatggtttctggataaccaagaattaccgcgaaagctatggcatgtttgccgtaaacggcattttgttcaatcacgaaagtgaacgccggggcgaaacttttgttacccggaaaattaccctggcggcagcacgcatcgcacaaggattccaagataaactgtacttggggaatctgaattccctgcgcgactggggatacgccaaagactatgtggaatgtatgtggctgattctgcaacacgatacgcccgaagactttgttatcgccaccggagaatatcacactgtacgcgaatttgccacccttgctttcaaggaagtgggcatcgacttgcactgggaaggtgaaggtgtgaacgagaagggtattgacacagctacaggcaaggtgctggtagaggtggatcccaaatatttccgcccggcagaggtggaacaattactgggagatcctaccaaagccaaaacgttactgggatggaatccccgcaagacttcatttgaggaactggtgggaatcatggtgaaacacgatatgaaattcgtgaagaaactccatcttaaagcaagctgttaaatcattagttaaaatttcaatggagaaatcagccaaaatttatatagcagggcaccacggactcgtgggctccgctatttggcgtaacctgcaagaaaaaggctacaccaacctgaccggcagaagtcacaaggaactggacttactggacggggttgccgtaaaggacttctttgaccaagaaagaccggactatgtaatccttgccgccgcccacgtgggaggtatcatggcaaacagtacatacagggcggactttatctataagaacctgcaaatacaacagaacgtgataggagaaagcttccgtcacggagtgaagaaattattgtttctgggaagtacctgcatttatcccagagacgcacaacagcctatgaaggaggatgctctcctcacctccccgctggaatatacgaatgagccatacgccatcgccaaaatagcgggtctgaaaatgtgcgagagtttcaacttgcaatatggtactaactatatcgctgttatgcctacgaacctgtatggtcccaatgataatttcaatctggaacgcagccatgtgctgcctgccatgatccggaaaatacatcttgccaaatgcttgaacgaagataactgggagaacatacgctatgatctggacatgcgtccggtggaaggtataaacggagagagcagaacagaggagatactggctatcctgaaaagctacggtatcagcaaggacggggtggaactgtggggaacaggcacgccactgcgcgaattcttatggagtgaggaaatggcggatgccagtgtattcatcatggagcatgtggactttaaagatacttaccgtcccggcacaaaagagatacgcaactgccacatcaacatcggtacgggaaaagaaatctccatcgccggcctggctcatctgatagtaaaggagacgggatataaaggcaacattacattcaatccggagaaaccggacggcaccatgcgcaaactgactgatgtgaccaaattgcacgaattgggatggcatcacaaaatagacatagaggaaggggtgcacaagatgtaccaatggtatctggaatataaaaagaaataaagaacatacgcgttatggaaactcatatcgttatcatggcaggcggcataggaagccgcttctggcccatgagtacgccggaatgtcccaaacagttcattgatgtgacgggatgtggcaaaagcctgatccaactgacagtggaacgctttcaagggttgtgcattccggataatatatggatagtgacttcggaaaagtataaggagacagtaaggaaacaattgccatctgtgccgcctcatcatatactgacggagccggttgcacgtaacacggcaccctgcatcacatacgcttgctggaaaatcaaaaaacaccaccctgacgccaatattgtagtgactcctgcggatgcattggttatcaatacggatgaattccgccgggcgatagccaaggcactgctgatgacagatcaaagcaagggcattgtaaccataggtatcaaaccttgccgtccggaaacgggatacggatatatagccgcaggagaagaggtggatcaggatataaggaaagtggatgaattcaaagagaaaccggatttgaaaacggcacagcaatatgtggacgccgggaattatttctggaatgcagggatttttgtatggaatgtaaaaaccatagaagaggctatacgccgttatgcaccgggcatcgccgaggtgttcgacaggatttatccggagttctataccgaaagggaaaaagaaaccatagaagagctgttccctacttgtgaaagtatatccatagattatgccgtaatggaaaaagcggaacggatttatgtattgccggcagagttcggatggtctgatctgggcagttggggctcattacattccttgctgcccaaagataaccggaacaatgccatcgtaggcgaaaatatccgattgtatgaatgtaataactgcattgtacacacaccgcatttgaaacaagcggtgatacaaggactggacggatatatcatagccgagaaagagggaaccctgctgatatgcaaactggcagaggagcagcgtattaaagaattttcgaaagcataaggaatgattatagcagttgattttgacggcacaatagtggagcataaatatcccgaaataggcagggaactaccctttgccatagaaacgctgaaaaaactacaacaggaacgacaccgccttattctgtggagtgtacgggaaggtaaattattacaggaggccgtggatttctgccgggagcgtggattggaattttatgccgtaaacagcaattatgcggaagaaaccctggaaagtgatcattattccagaaaactgaaggcggatttgtttattgatgaccgcaatctgggaggactgcccgaatgggggatgatttacagaatgatccatgacaaatggggatacgaagatatttatcaaagttcagataataaagaagagaataaaaagcgaagcttttggaagatacttttttccaagatgtagaatccccgcttccgaatgtagtgatacagggggaagcccataagaaaactaatgttagatcagaggtaagtactgttatcagcggataacggaaacttacgaagtagtgttggtgatacccgcctgggaaggtaggtatcacctttttttgatctataccattagtatttgaatacttgttcttttccgggttctatggtcatggctttcattcctttccgggttggaatgttcagtattccctttccgccgtcggacttgatacggattactttcttatccatatagatatggatattgccgtatggagtaggtactgttccttccatccatttcaacccgcccagacaaggggtgacggagtattcctcgtaaccgggtttggtgggttttactcccagatagtatttgcccaacaaatagatggggctggctccccatgcatggcagaggctcttgccgtatggacgtccatacatggccaaatgctgggtacctgtttcttcgggattgtatttctcccaaaaactggtagctccttctttcaacataccgccccaataggctttcatttctttcattaccgattcttgttcgcccaaggcgcacagcgcttccagttcatagaaacgcatataaggagtggtgattttcaaaatactgtcattctgcaatacggagtgtttgatggcctgctgtttatcggcattcagataattgaagaagacagagaacatattggcgtaacgggtaacggactcactctgctttccctgaatacggttgtgtaccatcgcttgtttctgctcattccagaaagcgggttccagcttggaacgtaaagcggaagccagtttctcatacttggttttgtctgccgtattgccggccagactggcacaaagcgccatggtttccaaacttttgcagaacaagacttgctcaaaggagagttcgcccttcttgtccagataaccgtctgcccagtctacgaatacccagtcaccgatcataccttccaccataccgttggcgttggtacgtcccaatacatagtccatcatgctttgcatacgcggatagagttgggttacaaagtctttgtcaccagaatacatataataatcgtaaatactgagaaaccaatagaaggtgtagtccataatggtattgctgtgactggtcacagggtcttttccacgaagcagccaaatggtacgtttcacggtttcattatcgaagaacagatagtagttcatcagataactctggatggcatcgccactccatacccaacggtcgcgcttgatgccgtcgataaagaattcacgggtagtaaggtgcatggtgtacgctcctacttcccaaatgcggttcagctcttcgtcattacatttgaatgagccccggtactcttcgggcaagtattcgtattgcatggaaacgtcctgcatcgttactcccggatcgcaagtgacatagacataacggaaagccttgctattgtctaaagtatattcatcgtatagtttccgtgtattccggatggccagatcggttatttgccccggctctgccagcaatttgtccaatgtttcgcaatattccgtatccaaggcttcttcaggactttcaccgtaatagatatggatcgttccttttccctttacatctttcagagtgatataaccaaaggtttcttttccgaagtcgtacaataccccctctttccggggagtggaggaaactgctttcatcggttttctaaccaatgaaaacttggaaggcagttgggtggctccgtcaaagttccaacaccctgcatccatataaacggtagcagaagtatcactggcttttccgctttcgtctatccattctttatcctcgtaggttactttccaagttttgtccgtatttacggtttttcctttcacataaatagtggggggagtggactgattccacactttgatgttcagactgtgttttcctgcggggagtttcaaggtggagggcataccgaattgcagtttaccgtccaatttcacattgtattttccttcggcggcaatgaagatctcttcaggttccgccaggtccaatttcttgctgaattccactaccacataatggctgtctgttttccagaagggagggaaaaaagcaccgcgttccgtacggcggttgttcatctggttgcccagccatatttcataatcacccggataccagatccaggtctgggcggaggcggcagcactcaatgcaagtgctccgactaaagtggcaagtctgtttttcataatggtatcacgttttatttttccttcaaatagctatattcctttgtcagtccggcatttgccttgatactgtcgttcaccatcggaccattgttttcccatgtattacccggaccattggcgttcttcagaaacttctctccttccgtccagttgtccttgacggtgataaatgaagatccttcgtcggtgtaaagatagaaccaatgattgggatcgtgtgcataaccgggtgaaaaaatgttagaaacgcaattttccgtaatccagctatgaggttgtgaacctaatgtataaataccggctacatcatacatgtgcttggcatagtgatgaatcagattggcgtgcacgcggttattgcgcatacagtttactgtacgtgtccatccccatcccaaactgatgcccgaataggatacatcactgatttcattgtgttcgatattgatatcacttacataaccggcgcaaatgcccaaggtaccccagtcttcattggtcacatcattgatataattgttggaaatggttagtccggtacagacctcacgacggtcggcaggatcgtatggaagatgtgtttcgtgagcggcaggactgaaactacccgccacaataccgtttccggcaatatcacggaaaagacaaccgtttatacgtcctccaccggtggcccattcataatcaatacctgtagagcccaaatgctggaaacggcacttctcgaaatcaatatcctgggcagccttgactacgactgccgatgccggacgtcccaaccaaccttgattatccagcttatgattgttcttacgaatcatagaaggacggattttatacccgtctgtcatgtacatacctgcctgaagaggaacatgaccttgcaaagagggacgcatccaggtggtatattggaaagtaacattgtcaaaacgaatgtgctttaccggacggtctatagttccttccacccatactaaagtttcgatgccgggaactacggctttgcttatcttctctcctttccgaggataataatatattttacggctttcaatgtcatgataccactcgccgggttcatccagcaattccatggcattggtcagatagaaagccgagttgtgaccatccttagtcaccataggacgcggccacggatgttcaaactggatgcggctttcaggattatggaaacgcacggcggcactgtctccctgtatttcgaccgacttgatacggagatttgccacacaccacatttcatgaaggaccatttcggcatatcgggccttctgtattttctttacagcagcggcaggtacccacagtatttcgttttggggatcgttgttgatgatgcgatacatcttttcaaagtctgccacatcccttgcacgaacagccttttgtccattgatccacagttgccggaaatccagcggacgtccgttaaacatagggacatcggctacccacaactttccttgcttcttccagtttctgatttccaccccaccattcagaatggcatttccatccgaagtgatgactgtaggtgaagcttccgtcccgctgtcctcgggacgaataaagacgggttcgtacagatggtaatcacctgcctccatatgaatggtgatgccaccttttacactctcatcattaagacgacgaagttcccttgcctgacgcaatgcggctgtaagggtggccttcggagagtctttggtacccggattccggtcattacctttcggagatacgaacaaatcggctgctgatagtgtacaagctatcagcagcgcagtagtggttatgaatatttttttcatttgtaaatcattaggagtaagtggttagtgattagtccgcgccaaaggcatccataccgtcatttcagcctttccgcgatttccccatgcataataaggaatcagacggatattgaccggtttgtcggcctttcctacctcgcggtacaatgtatctttccacgatacctcatcaaccagacgggcagtaccatccaacgcgacaatcggactgccttcaatgattatttttttcggggtcaaccggatatcggcaggtatcagcacattatctatcttatgtccgccttctatatccatactttccaaacaatataccaacgggccacgttttaccactacctggttacggatttcttcggccaacggatttgcttccagcaattttacaggcatatccatcacccattccacacagtcccctttcttccagatgcggtttacctcggcgtatgtattcgctttccaagttccttgcaccggttcaccatttaccttcaaagttgctttctcgcaccagtccggaacacggaggaacaaagagaatgctttcttttttgatggtttcggagcttcggtaacagtcagcttcacagcaccttcccacggatactccgtttcttgcatcagcccgatctttcccacttccttcaaagctgtcgccagtgtattcgctccatataaattgcaatataccgcattcggagtcaccgtataagcatagttctgggcttgacaaacggtgcgcagcgtattaggcggacaacagaagcaactgatatactcggtacgttctttaggccagcgaagtgtgtatggcaaatccgcactgatgcgcaacgggttggtatagaaatatttctttccatccagactgacaccactcaacacactgttatagagggcagtttccacaatatccgcatatttggcatcgcccgtcacttccagcatacgccagttgaaaagcatattgccgatattggcgcaggtctcgttatgcgccgtactattaggcaactgataaggacggccatagctttggtgtactttctgaatactgtccggctcatagcaggtaccatccggcgaagtaccgtcatacagcgcaccgcacgctcctgtaacatacatcttgcgggtcacaatgtctttccagatgctggtcaggtttttcatcagttggtcttctcctgtttcggcatacacatcggtcacaccggcatacaggtaattggaacgcacggcatgtcccatcgcattgtattgctgacggaacggaatacggtcctgattatcatcggtgccattttccaccattccacggatatcaatcagattcttggaaagttccagataacggggattccctgtagcacggtacatttccaccacgcccatataatgggagggacaaatagcatttcttgccagttccgcagaagcggtttcatagaaatgacagagaaagtccgtcgcttttacggcagcatcgaataaagtagcctttccggtggcacggcgatgaataatacctgccatcatcagatgtcccaaattgtaggtttcaaaattcagacgattggcaaatgcacctttctcgtcctcaccgcctactttggtaccaattaccgtctgttgctgtttttccgaatgagtgtcaatccccttattcttttcctcaatgatgacaggggtatggatgtaaccgtccgcacgctgggctttcaccacatgttcaatgaagtggtccatcagtttatccaattcgggatctttcgtgacggcatacacggaagccactccctccatccatttatacatatcaccatcatgaaagggaggtccccaatgttcgccttcgcaaacaccggcagctatttcaaagttacggaaaccatgcgaaacatcgggattgttccatgtatcccacatactttgcaaggaggtatggctatatacattgaaacggtcgccccaaaagccatctgtccaatgcacagcacctaattccgtattggccatcttggcaaaacgactttggctcatatccgtcagcccgcccgattgggcaaatgctcccgtagttactccggaagccagtaaaagtagtagtctaatgctcttcataataatctgtcacttattcttttctttataaagagaggacgataataagaaacgtttgtactctatttataattatttcatattctgtatctttagaaagagctttcattggcagataatgaaagtctgttttcaaaaaacgggtttctgatttttatttcagacacccgtttttttcaagttctccaatactttctatcaaagaactcctttatccacaatcgtattatttcagtttgctcaaatccaactctttataagccacacgctgacggcgccaggtatatacggcatggagtttgccatccttgccctgaatgatggacggataagaatattggctgatagggctgtcttccaatgtcattacattcttccagtgaataccatcatccgaaaccgccacacacaacggtgtacgcggccctttcggagtgcccggcaatgtactgaaatcattataaatcaatacatgacgaccatctttcattgttacggcatccgtacccgaattattattgggaacatcaagcaaggtaactttactccatgtttcaccgttgtcactgctccatgaagtagcaatctgtgcgttacgtgtacggcaaagcacctgcaaacgcccatccttatgacgcaaaatgctgggctggatagcataaataggcttctcaccttctccttttatggcttcaccgccttcctgatcgtctacattggctgcatttgccttacgcaaagcagtaggcacactcatttccgcctctacaggacctaccatcttccaagtctttcctttatcatccgaaatttcaaaatggatacgccatcctccatcaccttctgtactggaaggacaaataatacggccatccacatactccggcttatttttaataggacctaagaaaccttttggcaacggttcacgttggctccaagtttttccaccatctttagaacgtaccagccaaccactccaatcggctactttcaatcctattttatagaacaggattaaatctccgccgggtatttggaaaagcacaggattccaacaagccttgcggcgtgcccgggacttatcccctttaaacgtagaagccacggggccggcatccgccggagtggattctgctgtaatgcccgccaaaacagcttgcggatcatccagactaaacaccccgtcggcagccagataaggtgcgctccattccgtcgcacccttcggcttgcgacatacccagatacaacaatccggattacgctctttagtacctccaaagaaagaagctaccaggtctccgttcttcaattccacaatagtagcgccatgacattcgggaaaagaagcttgctcgtataaaaactgatcttccacgatacctgcacggtttttacctaaagatggatccatactaaccgaaaaatgatagtttcccgaaggaacactccatacggtagagttgccttcccgacgtacaaaggtaacgtccttatcctttaccgccttctcgtccaaggtaggaagataaaccaatgcagtagtattacaaggaatcgtgatatcccattccagatgcgtaagagttttcttccaattactaatcatcttaccatataaagtgttgtgcgaagctttgacataactcaactcttggatggaaaaatccggtttaaagatgatttgtttgtaagcgggctgtgccggattaaatccggctaaatcacggaaataccaagtcaatagatcacccaatatcatcacatggttacaactgttcatccaacgattggcggtatcaccgttccacaattcccaaatggcagtagctcccttttctatcatatagccataactgggataagttttgttgcttgccaacaagaaagcaacatcgccacgccccatacgggtaagctcacgcatcatccaattcatacctatcaccccactgctgatgtgacctttattccgggtaataatgcctgttattacatttttttccacttcttccctataggcttcaggcaccatatcgaaagccagtggcaggatattagccgtcactgtattgttaccatagaatatgctgtcgggataaagaacatggggcatttgtaccggagaagttcccttcttaactgtaaggaaacgggcattgaagcagtctttaatttttgctgcatccttctcgaattccttcgcctcatcttccaaaccttgcaaacgggcgaacttggccagcatttgcgataccttataatagtaggctgtagcaatcagcgctccatccgtcttgcgggcagggtcctgactgtgaatcaattccggtgattcgggaggcatacaccagtcaccgtatttatcggcgttaatcactccatcctctgtagtgaactcactgcgtatatggtgcatccatttcttgatagcggcataatttttacgaataggttcgatattgccgaactgttcataaaccatatcacagattaccggaaatgtggatgaccacgtcatttccgatgtataataattgtaataagccggacaaatatcaggaatacaaccgtcttcacgctgcgcttcacggatgtcatccgcccatttggcataggtgtttccattattgaacatgaaactttccccccacgttcccatagcatggtcgcccagccagggctggcgctcgtcacgctggggacaatccaaaggcactcctttataattactggaaatcccccaccaggcattccgataaacccgattcatgatatcattggaacattcgaaagtaccgttatcttccaagtcatcatatactacttcagcaaccaaatcttccgctttcagatttttataacctgtcacttctacatattggaatccatgataagaaaaacgagaactccaggaagtgttgttttctttaccgttgcagatataataatccgtactctggctatggcggagattttccacatccagttccgtaccgtcattctttacccgttcggcataacgtatgcaaatcgtatctcccgcagcggctttcgctatgttaatacgcacccatcctgccatattctgaccgaaatcaatcatataacggttaccatattgcttgaagacagccggcttcagcgttttcatcactttcatgttgggagcggtattgccacgaagtgtaccgtacggcaatgaaacacgttgcgctttcagccatttggaatcatcataaccgggctgtgtccagtttcccaattccatacgggcatcgtaaatttcaccatcgtattcattattgctacgtataggcccttgagccgtcaaacgccatttctcatcactgttgatgcgctgtatactgccgtcggtatattctataatcagattcaaacgtaacttggggtaaccaaaagtaggaatcttataaggtttgtaattttgacgcatagtgtagaaacgtccgttgcccagggtcactccgatggcattgtcggcatttcctccggcaacctgtttagtgacatcaaaagaattgtaaagcacagtacgacgataatcacttggagccggcgccaatacctgatcacctatccgctgaccgttaatgaacagttcgtacattcccaaaccacacaaatgaagggtagcatactttatctccttggcttgcgttttaaattccgtgcgtaaataacgagagctcaaacggctgtgtgaatcttcccgatcccatgcaaacgcagcgtcccaacctatccatcgtcctccccaatgaatctcacctaaaggtcccatcccccatcgggcaggctcgctccattctgtctcacctcgattggtatagcttctcactttccagtaaacacgctgattgcttttcaaacgcttcccttgataaggaatccatacggacgcatcggattccacttttccggaatcccacaaatcccctttatcctgtgctaaaagttcaggagaagaggcaaccaaaatccggtaggcggtctgcatcacatttctttgagaagattccagccgccagctcatacgagggacagcagtatccagccccatgggatctaccatctgctcggtacgcaggccggtaaccgaaacatccgctgctttcaaccacaacggaagtgccaaaagaatgattaataatacttgttttttcatgatatgcatatttcttacttattccatttctgtatggcatccggcaaggctgtccaagctttctgcacataatcctttgcagaatccacaacaatcagaacctgatcattaccgctcagataaccgctatcatgctggaaagaagtgactttactgtcaaactcaccgatatattccaacttaccgtcctttgcgctataccaccatgcattctttttcgcaccgctgattttgctcaaatcgatctgcataggacgtcctgagtaattgtaaaccaacaaatagtcatttccacgggtagcgatggcacggtcatagcgttcgccgttagttcccgcaataacactctgatcgggcacacgttcaaagaaaggaaaagtcaacatcaagttcttcagatatttcatctgattgaagccgggatcttccaaagcatcccaccatgctttcttgcgtccgtcggcaccaaaagaggctccatatcccggacggataaattgcatgatatcattatgaccgtatgagtgcccgaatgatccggcgaataccgaccaataggcataacgacgcacatcgtgctgattccaacgggtttcattgggatcatgcagtccctgtggaatgtcttcataaataggttcatcatcaattaccggtttcaacggagtctttgcctgactggcttccacaaaacgccagttatcttcttccgtattctcttcgataggatagtcaccatcaccattacgctgcccgtaacgacggtgtccgctttggaacatattgaaatccagccattcgcggtcattaaaccaagtagccgacgtggtacgtccacgcggatggaaagtcatcagatgacctttgtctatgctacggatactgtttgccaacgcatcccatacctccgtcttattatcaccacggatatcccctcctatcatccaaataatattcggctcatccttgtaacgttccgcaagaaatttaccgtatgccacggcttctttttcattcatcaacccttgttccacgggagttccccaaatacataccatccctatatagatgccccgtgaagcagcacttttaataatatagtccatgtggtcccaatatccataaatccctttgcggttgatatccttgaaattaaaaccgtctatcatggaatactgaccgtaaatattcatggaaggcacaccgttcaatacctgcacctgcaccatgttatatccggcatccttgcacttattcagatagtaagaaacctcgtcacgattcaagcgttgcggcatcagccatccagtttcacccaaccagaagaaaggtactccattttcatgcttcaggtagcgtccctcctcggacaccaccagtttgccattcttccagggaatatacgttttcgctttctgcgccggcaaggaagtagagtaacatagcaataaagccaataaggaaagtaatgcgtgtctgttcatcattgtattttcaaattcgtttattaattaattaacaatctctaaacaagagcttttatcaaaacaacaaggtgttaaaaaaaggtccttatgttttttaaaaaaggcggttatcttttttaaaaagctcttgatcttatgagaaaagatgaagacttttttgacaaatgtcctcatctttctcagattattcctactacttcattttctcatattcaatagccgccaaaataaaggaacctactgacttcggatcattctctattaccggctcacctatataataagcaaaacttccatcccggtttcctttaccgcctaatccggcaacagcacaacagttggtaatagtgtacgaaccatcaggttcttctttaatgaattgtttgatcaggccattaaaaccacgttctgcagccatcttatattccgaagaaatatatcctttattcactgctttacacaagaaatacacaaaaagcgatgaagcagaagattccaaatagtttcctttacggttattttggtcagtcacctgccaccatacccctgtttcaggatcttgatattttacaataccttcggccaacatatttatgatcgtcattatactgtcacgtccttcgaactgcgccggcatataatccaatacatccaccacggcagcggcataccagcctatactgcggctccagaaattgggtgagcatccggtttccttatttgcccaattttgtgtcttgctctcatcccaaccatgataaaacaaaccggttttaggatcatacgttttacgggcaatcagctttatttgattcacaatatcggcattgaccgtagtatccttgaatacgttaccatattgagccaaataaggagaagccatgaatataccatccagccacatttgatgcggatatatcagtttgtgccagaagccaccttcactggtacggggctgttcggtcagttgtttacgaagagtatccatcgccaccttataacgcccgtctcccgtcttttcataaaaatcgaataaaatctttccggcattgatattatcaatattaaaagaaagatatttcatggtctttatcttaccgtcagtgtctatcagactgtctgcatatatttttgcataattataataggctgtgtcaccggtgtgtttccattcctccaacatggatttcaccaccagtccgtgcgtatagccccaacgaggctttttcgctttttctatcatccaaggctcagggaaacgttgcatttccgactgagccatacgttcgctccatttgatttcttcggtctgtttaggagtggcagtacatgcacacattccacctaccagcaacaatgagcaaataatgtttaatcctgttcttttcatatttcttctttttactatttttcatccttacaatcagtgcaagaatcatcacttacctaagaatatatattcttcacctgctttggtttccagatcataaagataagtttttttcaactcaactttattcaatttcgcttctttatttataatcggttgcaagatttcgggtatggcatacaatttattcggattctccccttttgccgttctcagccctttgcctgccagcggatttaaagaacgcaaacgacagttccccccattacgggatttcaccaccaaccggctcactttaccattcttccaactcaaatccaattcaaaacctccacgagctataatcccgttcacgcttccttctttccattgcgccggcaatgcgggaagtaaataaataaaaccatcgtggctctgcatcagcatttctacgatacccgctgtacaaccaaaattaccgtcaatctgaaaaggtggatgggcgtcaaacaaattaggataagttcctccttttttcttctcgttacgtacgagagtcaactgatcggttatcagtttataagcatgatcaccatccaacagacgagcccacaaacataccttccatcccatactccatccggtagacggatcgccacgatggatcagcgaagtacgtgccgcatcaaacaattcgggagtacggtaaggagaaatctgattactggggaacaaaccataaaggtgtgacacatgacggtgtacatcctgcggattgtcccaatctgtcatccattcctgcaattgcccccaacgtcctatctgcatgggtgccatttcctttaaacgctgttccaaatgggtggcaaattcagcatccgtacccaataatcgggcggtagtgattatctgattccataaatcgaatatcagttggttatccaaagtacacccggcagccgtagtcgcttttccattactgcccgcatgagtattctccggagaattgctcgggcataccaccaaccaattatgtaacggttccttcaccattatttcatcaaaaaacttaccggcttctttcatgatagggtaagccgaacggagaaactccatatcgcctgtataaagataacgttcccacaaatgacggcacagccaagctccacccgtaggccataatcccgacggagccttgtctatagctccggtaacacgccatatatccgtattgtgatgcaatacccaaccatccgccccatacataatctttgctgactcacgccctgtttcactcacttcacgaatcagctgtatcaaaggctcgtgcaattcgctaagattcgtcacttcggccggccaatagttcatttcaacattgatattacaagtatatttactatcccaggaaggaaataatttatcattccaaatgccttgcaaattagcaggctgcccacccggctgtgaagaacaaatcaacagatagcggccgaaacggaaataagtagctaccagaaaatcatccttcgtttccttgaaattctgcacacgcatatcagtggttacccctgcatatttgtctatacctaaatccaaagagacacggtccatatattgcttgaaaaaatcaacatgtgccttacgtgatgtcacataatccttacttacagcccggcgcagatagttcttcgcacgctccacttggttacctgttatatccttataattagtaaagttggtagcaatggaaatataaatcacagcctcatccgccccttctatactcaagactccgtcacgacaagcctgggtccctccttgactacgtgcagtcatacgtccctgaaattcgactttcccttttagcccctcatgccaagaagatacgcccgaaagggtaacctcctccccttccgtcgagaccatcacatcctgatgcggagtagtaagattggcattacaagtaatctttccgggttggctggcagtaagacgcaccataactacctgatcagcaaacgaagtcaatgtttcacgctgataagtcaccccgtccaccttataacgtacaatggtacgagctgagtccaggctcagttccctatagtaatcggaataacgtgtatgccccggaaaagaaatatgcagatcgccaaacgattgatagggcataccactattggttttcgccattattttctcagtagccaatgtttgtgcttcaagatattttccttcgaacaccaactggcgcactttgggaatatattccaacgcattgggattagcattattattgggacgtcctgcccaaatagtttcttcattcaactggatatgctccacaccgggattgccgaataccatcgctcccaaccgcccgttacccagcggaagtgcttcagtccaaacttgagcgggttcatcataccacagtttatattcttgtgcggcagcctgcaagtaagaacttgcccataacagcccccccactatccattttattttcatattgatctctagcttttattaaagggagacgaaaaataaagacggatgtactctgtggaaagaaataaaaaagtaaatatcatgaaaaaactttccctagtacctcaacaaatccggcttctctattgttattaaaataaaaccatcttataaaattagaactatatgaaaatagcagagattaaaggaagagagattttggactcacgtggtaatcccactgtggaagtggatgttatattggaatcagggattatgggccgtgcctctgtcccatcgggtgcgtcaaccggtgaacatgaggctttggaattacgtgatggcgacaagacccgttacggaggcaaaggcgtattaaaagctgtagaaaatataaatactcttatcgctccggcattgaaaggaatggactctatggaccaacgtggtattgacaaagccatgcttgatctggatggaactccaactaaatcaaaactgggcgcaaatgctattttgggcgtatccctagccgtggcaaaagctgcagccaattatttggatattcctctttacagatatattggcggaacaaacacctatatcatgcctgttccaatgatgaatatcattaatggaggctcacacagcgatgcccctatcgcttttcaagaatttatgattcgtcctgtcggtgctaaaacattccgtgaggccttgcggatgggcgcagaagtattccatgctttaaaagaggtattgaaaaaacgcggactaagtacagccgtaggagacgaaggtggttttgcccctgcattggatggcaccgaagatgctttgaattgtatccttgccgctatcgaagctgccggatatgaaccgtttaaacatatcaccatcggcttggattgtgcttcttccgaattttatcatgacggcatctatgactataccaagtttgaaggcccaaaaggggaaaagcgcagtgccgccgaacaggttgcttatctggaaaaattgagttgggactaccccattgattcgatagaggatggtatggcagaaaacgactgggaaggatggcgcatgctgaccgagcgtctgggcaatcgctgccagctggtaggtgatgacctgttcgttaccaatgtgaagttcctggaaaaaggaatcagtgaaggttgtgcaaactctatcctagtaaaagtaaatcagatcggttcgctgaccgaaactctggatgctattgagatggctcaacgtaacggctataccactgtgaccagccaccgttccggtgaaacggaagatgctaccattgcggacatcgccgtagctaccaatagcggacagattaaaaccggttcactgagccgtagcgaccgtatggcgaaatacaaccagttgctccgcattgaagaagaattgggcaaccgtgccgtatatggatataaaaaaatagcacgcaattttaaagcgtaagcggtttgtatccccaattccataaacgaagaatgcctcaagacggatcgtgatgattccggcttgaggcatatttttgcactattatttaatcacaacagggttacaatgtttttcctcccattcctccaccgtcatggtttccgatgaaaaactgataccaattcccgtaactttgcacgtatctgtcagataaggcttagcatatcctttgtcctctatctgctgtaaagcttcagcagccgtactatccagtttaagctcaaatatatatacataatcctttgtttccaatatacagtccactcttcctcttgcccgagttttttccacatgcaattgacaatatagctttctgccgcctcagctgtctttatcgagccgtgaaaatcatacggtatttcagaccttacacagccggcattccacaacacaagaatatttttctttcaatccctccaaattcatccccgtaaaataatcctctataaactcccatcgctgctcgtcacttaacttcgtattgccaaagaacagccggaacaactctatctgttcctggaatattttctcattattctccagcacacggttctgatagccctccgaggcagcttcctttttcaatatctccgcatcacgaacacgcactccaacagaaggaacacccccctctacggtaaagtccaccacattgagcatagacagcaagttgagcaacatattgagatcggagaacggagtgacatagaacaacagccggtctcctttctttcctgtaatacgctgggcacacaacttctggtaacgggacaataacaaatcaaaaccacgggtaacggtaaacatcagtttgtcttcatctttcttcttggcactggtgatgtaactcacacttctgccctcctctaccctggactccagtaacgaagtgataaaacgcttggcagaaggaacatccatatcatacgccgcaaaaatactacgcaaatcgtcctcctcgaactttcctttattaccatacagactcaccgtcaacaaatctttcaaactcttcaagagacttgccagcttggagcagatatccgctgcactctcttttaacaagacatcatgcttccccacagcagccgcacgaactccctcaaagagatttccattgtataaatcgcgcttaaactcacgataccccatctccgagaaacaattttcccacaaagattcaaaagccaccttatagaccccttcaaccccttccacgggaaccatatactgcttgtattttttacggaaagcggcatcacccgtcttttcctgtacatagccatcggcaaacagagtctgtgaattgatttcaacaggagaaccgccatgccggaaactcagatcctcttctatccataacaaagccgtcttgatgacttgctccaaatccgattcatattccagcttgttctttttacgaggcagcctcactgcaaattcaaaatcggataaagagatctgcatttcatcactacagcctttcatcagatatatttcccatactttcttcagaatcatccccaactgttcctgggagatggcacctgcagaatgcaggcgtttcatataataaaagtcgcgttcattaaagtccgtcgctgccacaccagaaatgttcttatcacgggctgcacggccaatctcctgaatataatcgacaaaggtaccggatggagccacatgatacacacggtcaatatcgctgatatccacccccatgccaaaagctttcgtagcaacgattatttttttctcaccctccttaaaagcttgtataatttcggctttttgctctttatcctttttaccataataagatgccacccaatgccagttagccggatacacccaagtcttcagtttcatatctatacctccggcaaaaggataataaataatagtcttatgcccgtccagaaaatcctccacccgggcggcaacagtacgttgcttggccttatcgtaggtctctccctcctctatggtcatggcggtaatgtcaaagccaatattttcacgcttcaccgtgcccacgtacaaggcacacggagcaagatgcaacgaccggatggtatcaaaaatcatatcgttcccacctttgggattccacacagcagtggctgtcaatgcaaaaacagggaatacatatcccaacgcattctttaaagcttccagatgacgccctagaaaccaataatccacccggaactctttaccccaagtagtcacggtatgagcctcgtcaactactaccaatccaatgcggcgttcacctacgaaataactaatatcatacgccaacaataattcaggggaaagataaaaaagatcaacctccccgtcacggacacgacgatatacttcgttcttttgttcaggtgaaagatcggacgaagcatacgccacacgttcatatcctaactcctgcaacgcctcaacctggtccactatcaatgctttcagcggagaaaccacaagagtaagaagcttatattcattacccagataaatggcagggagctgaaacaacaatgattttccagctccggtcggagcagtcaggagcaaattatgaacagacgaatcacccttgatccctttttcagcttccatgatgacttcctcaattaattgcccttgagacaattgcaatttttccttacctttgaacaagtcatcataaacttctaaattacggaaatcttcatatccgtacacttcctgcaaaagaacctttaccgcttcacggcatttagacggcaatactcttgccgcaatctgtgactctatcatacaaaagaactcttaaataacggttgtaccaaccttaaaactaatatcagcgcaaatataataaaaaagcgagaagaatgaagatttcttcgtccttctcgcttttctgagcctcttgtcggattcgaaccaacgaccccgagattacaaatcacgtgctctggccaactgagctaaagaggcgggtgggtaagcttactatatcgcgccgctacaaccaactacctttgctgcgatcaagccctggaggattcatcaggagctggccgtataggacttacccatttttgttttgcgagtgcaaaggtagacattattttcaaaactacaatactttcgaatacttttttttgattttagcagaaaaaatacatttttcacccataactataggacggattcccgtaaaagaagtacttttgtgcacttattaataaagaatgacgaattataaaccgactttgcaggaatgcgccatgcgctatggtacgggcatgggtcttttatgggccttcaaattcatgctcttcccactaggattgagaatacctttcctacaattactttttatagtcttaactataggagtaccctttttaggatacatatttgccaaaaagttcagagaacggcattgtggcggaagcatcactttttcacgtgcgtttctattcactacctttatgtatatgttcgcctctctatttgtagcggtagtgcattacatctacttccgctatatagatggcgggttcgtattcgaggcataccgctccatcttaaatcagttcaaagaaactgccggacccgaactgacaacctcactaaaccaatttgaagaagcgatagatttactgtcgggacttaccccgctggaaatgacatttcaactgatatcacaaaatatgttttacgggatgctaatggctatccctacggcattgatcgtgatgcgtaaaaagaaaaatgaataaaagatggatatatctgtagttattcctttgtataacgaagaagaatctttgccggaactattcgcatggattcaacgtgtaatggatgccaaccacttcaactatgaagttatttttgtcaatgacggcagcaccgaccactcctggcaagtgattgagaaactacgctcggaatcggacaacgtaaaaggtattaaattccgccggaactacggcaagtcccctgctttgtattgtggttttgaaaaggcgcaaggtgatgtggtgattacaatggatgccgacttgcaggacagcccggacgaaataccggaattatacagaatgattacagaagacggctacgacttagtatcaggatacaagcaaaaacgctatgacccgttatcaaaaaccattccgaccaaactattcaacgccacagcacgtgccgtctcaggcatcaagaatctgcatgactttaactgcggactaaaagcttatcgtcatgatgttgtaaagaacatcgaagtatacggtgaaatgcaccgctatatcccctatctggcaaagaatgcaggttttcctaagatagccgagaaggtagtacaccatcaggcacggaaattcggtaaaacaaaatttggcggattaaaccgtttcttcaatggttatctagacctcatcactctgtggtttttatccaaattcggtatcaagccgatgcacttcttcgggtttatgggatcattgatgtttattcttggtttcatttccgtcattatcatcggagcaaacaagctatatgccttgtcacatggtttaccttatatattaattactgattctccttacttctatctggccctaactttgatgattttgggaacccaactgtttctggcaggattcataggagaactgatagcccggaatgctcctgaacgcaataattataaaatagagaaagagttttaaaatgaagagactaccagccattatcttattgctcctgattaccgtaagcaccttgatgcaaagctgtggggaaagcgattgtccgcttaccaccaattcctttgcccatttcgactttctggatgcagaaacacaccaagctgtgaaattcagtccagcttttgacgtcactggatttatcactaccgatgtgattgtacgtgacacactggaagatggaactattaaggaaactgtagtaaaagactcattgatgaatgacacgatattcaataaagcggaaagcagtatgagcctgcctttgagttatacatcaaaaactacctacgtattgcattatacggaaaagatgcgtgacaccatcatactcattcaccagaatatcccctacttgcagaatatagaatgtggcaccatgatgttttataaagtggaagacattaaatacaccacttataacttaaaatctatcgagactgtaaatccggacatcaataatgaagaaaaaaagaatttcaacatatattacgttgttaacgctactgagtagtatgctattgtacagccccacactggcggcacaagaaaaaaaaacaaccatagaggaagaaaaggtacccttctatcagggaactactatcggtatagatatatttggcctgggaagcaaaatttttggaggtgacattacaagtacagaaatcagcgtagaggtcaatttgaaaaaccgttatgtccccgtagctgaaattggatatggaaccaccgacactactgatgacggtaccaatatacattataaagcctcagctccctatttccgtataggtatgaactacaacttctttttcaagaagccctatctgcctggttttctgtatggaggcatacgttacggattcacctctttttcatacgatgtagatgctccgacaatgaaagaccctacatggggatttccggaaatccccttcagttatgagggagttaaaaccacagcaacctgggccgaactgctggcaggaataaaggtaaatgtatacaagaatttctatatgggctggtcactgcgctaccgcatacgcatgaacatgaaaaagacggaacacaccgagccttggtatattcccggtttcggaaagaacaactcgactaacttaggagtaacatacagtttaatatacaaattaccattttaactaatgacaactttagaaatatggctccttgccatcagccttgctatggactgtttcactgtttccataacaagcggaattatcatgcgtcgcatttgctggcgcactttttttattatggcattcttcttcggtcttttccaggccgtcatgccgcttatcggttggtttgccgccagccgcttcagccacctgatagaggattacgaccattggatcgcttttgggttattggcattcctgggagggcgtatgattaaagagagtttcagcaatgaagacaaatgctgcttcgaccccactaaattaaaagtggttgttacgctggctatagcaaccagcattgatgcgttggccatcggtatatcatttgcttttgtaggaatgaactctttcacttccattctttctcccattggcatcatcggctttacctcttttgttatctcaacattaggaagtctgataggtgtattttgcggcaagcgtttcaacctgcgcatggaattatggggaggtttggttctgattattatcggtgttaaaatcttaatagaacatttatttctttcttaactaaaatacaggtatgaataaaaaaaaattagcatggcaattgccgtttctagcaattctgataataggaacaattattattctaaaaaagcaagcacctttccgtacggatgaaggctttgtattcggtactgtatacaaaatcacctaccagtccgaagataatctgaaagaagaaatagaaaccgaactgaagaaagtggactactccctctctcctttcaatccgaattctgtaatcacccgcgtaaaccacaatgaaaagacagaagttgacagttttttcgtacatgtattccatctcgcaaaaaaaatatccgatgaaacccatggagcctttgatatcactgtcgcacctttggtaaatgcatggggatttggattcaaaaaatctacaggagtggattcactgatagtggacagcttacgcccaatgataggatatcaaaaaatagacttacagaacaaccggataataaaaaaagaccctcgtataatgctggattgcagcgctatcgccaagggattcggagtagatgcagtagcaaggctattagaacgtaaagggataaaaaactacatggtagacatcggtggtgaagtagtggtaagaggcaaaaattccaaaatgaacgcttggcgtatcggcataaacaaacctgtagatgactccttgtcagtaaaccaggagttacagactgtacttgccattagtgacgtaggtatggcgacatcaggaaattatcgtaatttctattacaaaggtggaaagaaatatgcacataccatagacccacgcaccggatacccagtacaacatagcatcctgtcatccactgtcattgcaaaagattgcgccagtgccgatgcatacgctactgctttcatggtgatgggactggactcagccaaagctttttgtgaagcacatcctgaactggatgcctattttatctgctcgggcgaaggggataaatatgaaacttattttacaaatgggatgaagaaatttatcgccagcgagaaatagacatcaaagaggcgcatcaaaacatcgaacaactatcattcaaatggaatgataccggaactcaccacagattaatatcaatttaacacaaagcagttggtttccaataaaatatctatggtgagttccgacattattatctgcaaagaaacagcatattactgagctttctgaaactgttctatcaacaaagtcagattagccgtaaataaacgcgctgatattgctaacaaaatgattccgaaaaacttacgaataacataaattccacctttacccaagaaacgttcgatacgatctgtcaacttcaacaccacataaacccaaaccatattcaatatcaaggctacaacaatgtttacaggagcatactccgaacgaagggaaagtaacgtagtaaacgcccccgcacctgccaataacggaaagaccaaggggactaaagtcgcttccttgataggaccttgattcttgaatatttcgatatccaaaatcatttccaaagacatgagaaaaataacaaaagcacccgccacggcaaacgaagcgatatctacctgaaataacttcagcatcatatctcctgcataaaagaaacctatcaataaagcaaaagaaatgccggtagctttattagcattgacatttctccctttctgcttaaggttcaatataataggaatagatccgataatatcaatgacagcaaaaagtacgataaacgcacttaaaaattcttgaaaatcaaatgatccaaacataaactcctccttttttgaatgcaaatatatttattttttatacagcccgcaagtattctgcttttaaacattaggagacggtaagaaacaataaaaaaaataaaagttctcccacctataaataataaatctcgttttatcgttacctttgtgtgttaaactataacttaacgaacattagaacttatggaaataacaatgtatgatacacttttacaacttcctctcttccagggattatgtaaaaatgacttcaccaatatcataggtaaggtaaagctacattttcgtaaatacaacgccgatgatatcattgtggaacaaggagcaccttgcactcaattaatctttctcttaaatggggagataacctcccaagcaaccgataaccaacattcatactccttatttgaaacttttggaagtcctttcgttatagagccctattcattattcggcatgcagaccaactatacagcgacttacaaagcacgtacaaatattaacatagttaccatagataagttatttgtattaaatgaactgaacaactacgaaatcttccgccttaattatttaaatattctgagtaatagggcacaagtggcatacgaaaaattatggaacagccacataggtaatacagaagaaaaaatactgaattttttagtactgcgttccatgaagcccgaagggaaaaaaattcttaaaatcaaaatggaagatttggcgagtttgattgatgagacacgaatcaatgtgtcaaaagtactgaatgatttacaggaacagggattggtacaacttagcagaaaagcaatctccattccggcattggaaaaactgaccgaaaagaataaataatcaggtaaaacctcataaagatgaaaagcacaggcatttctgcttgtgcttttttatttttaacctaactatttaatatactttgttaaataagtaaatagaatgaggatagtgatacttttttttagcaaatttgtaagtcaaataaaatagtgccatgactgaaaataaaaatccatttttaaaaccctataacactcctcatgacacggctccgttccatcttatcaagatagaacattatgaacctgccttgttggaaggaatgaaagaacaaaatgaggaaattgatgcaattgtcaataatcccgaagcaccgactttccaaaacaccattgttgctctggaaaattcgggtgcgttgctagaccgcgtaactactgttttcggcaatttgatgagtgccgagactagtgacgagatgcaggaattggcagaaaaaatgatgcccttactgtctgaacacagcaacaacatcagtttgaatgaaaaactgtttgcccgcataaaagctgtatacgagcagaaagaccagttgcaactgaaaggtgaagacgcccaactgctgcaaaaaacatacgacagttttgtaagaagcggtgccaatctgaccggtgaggcaaaagaaaagttccgccaactgaatactgaattaagcatattaaccttacgtttttctcagaatctgttgaaagaaacgaataactacgaattggcattgacgaaaaaacaattggaaggattacccgaaagttcattggaaagttatgctcaaacagcaaaggacaagggaaaagaaggcagcatcattacattggatgctcccagttttgttcctttcatgaaatattgtgacgaccgttcactgcgcagagaagtctatatggcttataatacccaatgtacacacaataacgactacaacaatgtggacatcatcaagcaattggtaaacattcgcatggaactggctcatttactaggcttctccacttttgccgagtataaactgaaaaagcgcatggccgaaacaagtgatgccgtatacaaattgctcaaccaattattggaagcctacacccctgccgccctaaaggaagtagcagaagtagaagcattggcacgcgaaatggaaggcaatgatttccagctgatgccatgggattgggcctattattcagaaaaactgaaaaataagaaattcaatctgaatgaagaagagttgcgtccttattttgagcttagccaagtagagaaaggcgtattcggtctggctacccgtctgtatggcatcacatttaaagaaaataaagaaattccggtctatcatcccgatgtaaaagcttatgaagtatttgacaaagacggaagtttcctggctgtactttatacagatttccacccccgtgccggaaaacgttcaggtgcatggatgaccagctataaggaacagtggatagaaaacggagtcaacagccgcccccacgtatccgttaccatgaacttcaccaagccatcagctggaaaaccggcattgttgactttctcggaagtaaatacttttttacacgaattcggacacgccttgcacggaatgtttgccaataccacttattcaaccatgagtggtaccagcgtatactgggattttgtggagcttccatcacaaattatggaaaatttcgccactgaaaaagaatttctcaatacattcgccagacattatcagacgggagaacccattcctgccgaactgattcaaaaaattgtagatgcatccaattttaatgtggcctacgcctgcctacgtcaaataagtttcggcttactggatatggcatggtacacccgccaggaaacatttgacggagatgtccgcgcttatgaaaaagaagcatggaaaaaagcgcaaatactgcccggagtagaagatacctgcatgtccgtacagttctcacatatcatggcggggggatattctgccggatactacagttataaatgggcggaagtactggatgcggatgccttctccttattcaaggaaaaaggaatcttcaaccaggaagtcgctgcttctttccgggagaatattctctcgaaaggaggaacggaacatccgatggccctttacaaacgcttccgtggacaagaacccagtatccatgccttgctgaaaagaaatggaataatcaactaaaaaactaaacaatatgaaactaaagtctattctttatatactgatgctactccccttcttatggagttgcaacaatgaagacgatgtagaggaaatctttgcaagcggcacatggcatgtagtggatttctatggtaaagccaattgggacaaacggaacggagagcccaaatacaatgcaatggcacacaacccggataagactatcgcagccgaaggaagaaaagccttggatatcattcatggtttcaacattactttcaaagcggatggcacttttacaggaagcatacaaaacggaaccattgaaggcacatggcaagcggatggaaaagaccggacagtaaacataaattttaccaagactccatcttcaacaagctataataacgagttcatagaagcattgaataatgcaatattttatcaaggtgacagcaatgttttattgctagctcccgaagggaaaaaaacttatattcaatttgcacataataagcaagactgaaataatggaaacgaaagaagaaaaacaactcaaactcgacaaacgatacatccgcatggctagtatttgggcggaaaattcatactgtgaacgccgtcaggtaggagcattaatcgtaaaagacaagatgatcatctccgacggatataatggaactcctgcaggattcgaaaatgtatgcgaagatgacaacggagtcaccaagccttacgtgctacacgccgaagcgaatgctatcaccaaaatagcacgaagcaacaacagcagtgacggagcaaccatgtacgtcaccgcatctccttgcatagaatgtgccaaactcatcatccaagcaggaatcaaacgtgtagtttactcagaaaaataccgtttggaagacgggcttgatttattgaaacgcgcaaatattgaagtaatctatatcaatcccaatgaataatagcaaataaagatatgagcaaacatcgaacatcccgttttatgccggtaatcgttgcggtaagcatcgtagccggaatattgattggaactttttacgccaaccacttttcaggaaacaaattaggtatcattaatacttcatccaacaaactgaatgcattattgcgtatcattgacgaccaatatgtagatacagtaaacatgggtgaactggtggaagatgctatgccgcaaattctaggcgagctggaccctcactcttcttatattccggcaaaagacctggaagctgtaaattctgatttaaaagggagcttcagcggaattggtatccagtttaccatccagcaagataccatccatgtaaacagtgtcatccaaggcggaccatcagaaaaagtgggcctaatggcaggagaccgcattatagaagttgatgacagtgcctttgtaggaaaaattgtcaccaactatgaatccatgaaaagactgaaaggtcccaaaggcagtgaggtaaaacttggcgtttttcgtccgggagaaaaagaaactttacacttcaccattgttcgtggtgacataccggtaaagagtgtagatgccgcctatatgttgaatgacaaattcggttacataaaagtaaacaagtttggtgaaacaacttatcccgaattattgatttcattagccaagctaaatcaggcaaactgcgaaggagtggtaatcgacttacgcggtaataccggcggatatatgggtgcagcaatccagatggtaaacgaattcttacccaaaaacagactcatcgtttatacacagggacgtaagtctccacgtgagaactatacatccaacggaaccggaagtagccagaaaatgcctattgtcgtattgatggacgaaggatcggcttctgccagcgaaatttttgccggagctatccaggacaatgaccgagggacaatcatcgggcgccgctctttcggaaaagggctagtacaacagcctatcgacttcagcgatggttcagccatccgtctgacaattgcccgttactatactccgtcaggacgctgtatacaaaaaccgtatgtaaaaggtaatgacgcaaattatgaaatggatatcctgacccgttacgaacacggagaatttttctcacaggacagtatcaaacaggatcaaagccaaatctttgaaacttctttaggccgtcctgtatatggaggtggaggtattatgcccgatatctttgtaccgcaggatactaccggtgtgacttcctattatcgtatgtccgttaaccgcggactaaccatccagtttgctttccagtatacggacaaccaccgtgccgaaatgcaaaaatatgaaacagaagaaagcctgttgcaatatttgaaacatcagaacattttggaacaattcgcccgtttcgctgaaagcaaagggttaaaacgtcgcaacatattgatgtacaaatcacagaaactatttgaaacaaatttatatggaaacatcatttataatatgctgggcatggaagcttatatagaatacttaaacaagagcgacaaaactgtcctcaaagcattggaagtattggataaaggtgaatcatttcccaaagctcccgaacccatagaaccgaaagtaagcgatgaaggaactaaaaaaacaactgcgcaagcagatagcgcaagaaaaacgccgtcacgacatcaccgaattaatgacaaagtccgctgctttgcttgagaaactggaacagcatcccaaatttgcatcggcccgtaccgttttgctctattattcattgggtgatgaagtacagacacatgacttcgttgagaaatggcaccggcagaaaacaattttgctgccggtagtcaaaggagacgaattggaactccgtatttatgcaggtagacaaaacctgaaaaacggcgaggcttatcacatagaggaaccgacgggagaagcatttacagcgtatgagaagatagacctcgccattataccgggtgtttcttttgatgcccaaggcaaccgattgggaagaggaaaaggatattatgacaaattactgcctcttcttcattcctataatataggtatatgttataacttccaagtaagcgaaaagctgcctgtcgaacctttcgaccggagaatggatgaagtctggactgagaatggaatactgaaatagaatctatcgtgataagaactgccccataagccactcttacatcacacttctttcaagtcaagtgtggactttacgaaaaagatgaaggaaaatccgtaaaaatccgcacctggcaggaagttttacaggaaccttcggagataaccaaaagaacatacagaagaccgcctagttaacgaaaaataatattgactatcacttgtgcccctacctgcttattcagattcttcaccaataaatcacgtcccatcatcaactcctgacggagcacggacgaagtgatatgcacataaagtatttgattcttgatataaagattactagtatatttggtaatggcagaccccacaacatctttccatgcttgtatcagacgatactcattcagtggtgcctccaaagcattctgccggaagaatttccgaatcatctcccctatttgttccgcatcattacgtctcattcagccacttcctttctttcagtcacacagccatcttctacagaaaagactctgtattccctttcaatctttttcaatattttatccagatgatccctattggtatccgtaatgaaaatctgtccgaaactatccccggccactagtttcacaatctgttccacacgggaagcatccaacttatcaaaaatatcatccagcaacaacaaaggagtgctattgctccccgttttcttcaaaaaatcaaactgagccagtttcaaagcgatcagataagttttattctgcccttgtgaaccttccctctttatagggaaatcacccaactgcatcaccaagtcatctttatgaattcctctcagcgaataccccattatacggtcacgtttgcggctctcttttattatatccagcaaattcccattcatagcatgagattcatacgccagattcactttctccttatcttgcgaaatataagagtagaaagattgaaaagtaggaataaattcggctataaactcactacgttttctaaaaacaacctcgcctgcaaatgccatcatctcctcccataccaacatcaattcctcatcaggttcctgctccgacttcaataaggcgttacgctgtgtcagcgctttattataacgtatcagtgcatccaagtattccttatcatattgagatatcaccacatccataaaacggcggcgctcgtcactacctcccgcaatcagttccgcatcagcaggagaaaccattacgagaggaataaaaccgatatgatctgataaacggctgtattcctttttattccgcttaaactgttttttctgacgacgcttcaagccgcaatatacctcttcaggatctccttgattcgtttcatagaaaccctgaatcacaaaaaaatcgccctcgtgacggatattctgcgagtctatgggattagtggcacttttacagaatgaaagataataaaccgcatccagcaggttcgtcttccccatgccgttctgtccgataaaacaattcatctttggcgagaattccagttctgcctgctccaggtttttataattcaatatcgagatgcgtttcagtatcatagaacttctgtttaattgaggatacaaaattagagataaaaacgggaaaaactaaaaaaatatgcccgtaaatttcattaatacatagaaatgaactacttttgctgaccgaaaaagtagattcgcaaaataataaaaaagtaaatataaaaatggcagaacaaaaacacactcaggacccattggatatggaagaagcactgagtacttcagaagcattccttatcaagtacaaaggaaaaatccttggaactattgcagcagttgtgattatcattgcaggtttcatgggatataagcattttatttctgaacccaatgaaatgaaagcatcagaagctttgttcaaaggagaacaatatttcggagccgataactttgaaacagcattgaacggcgacagcattggttacaaaggtttcttgaaagtagcagatgaattcagcggaacagctgccggtaatttagcaaatgcttatgcaggtatctgctacgcacagttaggcaaatatgaagacgcagtgaagtatttagataaattcagcgctaaagatcagttggtaagccccgctattttgggaactatcggtaactgctacgctgagatggggcaattggacaaagctgccggaactttgctgaaagcagcagacaaagcagacagtcaggcattaagccctatctatttgattcaggcaggtcagttgttcgagaaactgggtaagaacagtgaagctgttaaagcttatacattggtgaaagaaaaatacttcaattcttatcagtcaatggacatcgacaaatatatcgagcgtgcctctatcaaataagaaaagaaatataccttgaattatataaagaggttgtctgcacccacgtacagataacctttttcttttattaatcccactaaaaaacaaaaaataatggcaacagcgtatcataacttatctgattatgactttaactcggttcccaatgcagaaaacatgcgtttcggtatcgtagtatccgaatggaacagtaacatcaccgatcccttattggaaggcgccgtaaccaccttgaaaaaacatggtgcaaaagatgaaaatattttggtacaaactgtacccggaagttttgaactgacttttggttccgcacaaatgataaaaagcggaaaagtagacgcagtgattgcaataggatgtgtagttcgtggtgacactccacactttgactatgtatgtgccggtactacccaaggcatcgcccaactgaatgccgaaggagatattcctgtaatttatggtttgattaccaccaataccatgcaacaagcagaagaccgtgccggtggaaaattaggtaataaaggagatgaatgtgcaataactgccatcaaaatgctcgattttaagcaaaaagtgcagggaaagcagattttttgaaaaaaagttcttgtagaatttgcatattcaaaaaaaagacgtacctttgcatcgcaattgagaaacaaacctactcaataagagaattgagatagaatcttaagagcgaatgggcaaataccagagtggccaaatggggcagactgtaaatctgctgtctttcgacttcggtggttcgaatccatctttgcccacaaaaattgcggaagtagctcagttgatagagcattagccttccaagctgagggtcgcgggtttgagccccgtcttccgctctacagaagagatgattaaatcatctcttcttttattttatatcctacccttccttcacttacccgataattataagagcaggatgtccaagaattcttgttcggtttcaagaaaccaggttcatccgatatttcatagaggaacacttttgctttgtcccgtttttgtgacagaccctctgcaagtaataggtgaacctgataaaacttcaagcataactccgagaaactctgagcaaaactcgtcaaacctataaggatagtttgaaaaaaccttccggcataaagtgaaaaagggtgggacgctttttgggaagaagaaaatgcaaatccggtttacacgtacgtacgcatgaggcgatgcatacatatgtatagcttcatgcatacgtacaggccgggcttgtccaaaggacaggcctagcttgtttgacgaacatgcttagcttgttctgtggacaacgtcataagttatctatgagctataagatttaaatgtatgaactgtaagattaactactcaagttgccagcatccgaattgtctttacatgaaaaataaaattgttcaatcactataatcaattagtatccagtaatttgtggtgataaaaggacgtaaaagacgctcaagtggtttgaccccggacaagcccaacatgctccaagaacatgccatgcccgtctggttccggaagcgaaaagtgtatggcatattcaccgtcaactaccacttgggcatgtcttaccatctttctacacagtaaaccattgaacaacaataagatatggtgatgaaaggattttattccgttcgtaaaaacaaatgtatacatacaaattcgttttcttctgttgggcaatcaatcatcacattgctttattttactttcccaatcagttcgatagcccttgtccggtttcaagaagctacatttcctcctaccggagtgttcagaatcttgatacaaattctgccggatcctgcgccaagttctatgaattcttgtgccaaacataagttcctttcattaaaagataaggatgtttttccaaaacaataaggtcttttaaaaaaagataaggccctttttgaaaaacgaacttatctttttacctgtctgctaaaccaaaagcttcttaccatagagtgttctccaaaaatcttcactaaaaccgaaacaaaatgtgttttctaatgtaacaaaagactctaacagatcatttaaaagagctgaatctaaagtacaacccaccttacagcaaccgttaaacttttctgtttcccaattgttatatcaaatatcaacaaattaaaaaagaaaggatatgagttatgaaaacagtaattgacaaagctaatacaagagggtattttaatcacggatggctaaaaacctaccatacattcagctttgcagactattataatccaagacgaattcacttcggtgctttacgcgtactaaatgatgatacagtagctcccggagaaggtttcggtatgcacccccataaaaatatggaagtggtgtctatccctttacaaggatatttaagacatggagacagcgtacagaatgaaagtaccattgccccaggtgaaattcaggtaatgagtacaggcacaggcatctatcatagcgaatacaatgccagtaagactgaagacgcaaaattcctgcaaatctggattattcccaatgtggagggaactaaacccgaataccataattatgacattcgtccgttattgaaacgtaacgaactagccaccttcatctcaccatctggcaatacaccggcgcatctgctacaggacgcatggttctctatgggcacattggatgccggacaaagtgtgacataccgtatgcacaaaccacgcacaggtgtttatatcttcattatagaaggagaaataaatgtagcaggcgagaatctttcacgtcgtgacggtatcggtatctgggacattgaaagtgtcacaattgaagctaaatccgaagcgcaaatactggccatcgaagtagccatgtaagctatatatttgtgtcgcaatcatccaaacggaagatttgtgccacaaattcatctttgctcccttgttctatacccatctttctacaaattctatataccacacggtttacagaacgggactgcactcccaacaaactggctatctcatcaaatgaaagtcccactacaaacaggtaacaaatatccttctctccgttggtcagagatggataaagcttttccaatcgctcggcccagcgattacgggatatgttcaaccaatactctaatttagtacggtcttcagcaggggtataatgaggagttcccttcgtcacgatttgcaagtatacttgtgctgcctccaccgactcaaccggaagcgagatgtgtttcgaacggaaagtgagttccaactgacgaatacgtatttccttacttttcttttccttttcaaggatttgcatctgttcttgcagattcttcgcctcaccttgattctcttctatcctctcttgtaaatcatcaatctgctgctgcaacatggaagcatcccttttataatgacttaaaatctccagtttctggcggcgaaaaaatttccaactgccccatagcagtaaagtcaatgaaaaaacagcagccactgttatcaacagagtaatgctccatcggcttcgatattcatcattctgacgtaataaagccgtgtaatcatatcttttctcgattttaaacaattcagtacggcttccggaagtaaatagtaattccagttcattgatatagcattgcatatattcattagccttacttaacttaccagccgccagcaaatcctggtatatagctttgtacacagaggatctcaaaagtggtcgcgaagatttcaatgccctattacgaaggctgtctactagttcagtttttcctaaatgtttatagataacagctaattcagcatcataccagtaacgggactcaacagtagtggtatagtccatcgcttttaacaggaacgaagccgccgaatcccattcctgcttgcctttctccttcaaggcccattgataatagattttctcttgcgaggtaaagtccatcctattaaccaaacctaaaaacttatcataaaccaacttgacctcttcattgtaccggggagttccctgagccagataaagaggggcaaatatatattctccccccattgcattccaagccggaactgatagattaagatccaacgcctttctataatacgacagtgagtgctcataatgagcataccttccattgatattccctaaagctgtatatatcaaaaaatggatccgcaaatccttaacagtctttaccgcctcctctgcctgtttataggcatacaaagcttcattatcctgccccaagtcctctaaaatatatcctttataaagcaaagcggaagctttatcatctgcattaccttgtgaagaataatactgtacagcaatgtttatcaatgaatcggaagatatcttatgcccacatctatacatagcttgtgtcatcagtaatgcatagcacgcttgttcttctacggaaagtttatcgggaaaaggaatggcattcagtatccggtaggaggaatccggggcactccacaaataatatttcccccatgccagtctagaagtgcccttatcctgactgcaagaggagatgatacccaatatcaccaccatccatacatcccagcctataaacaagtactttctcatcatatcgcaaatgtatcactttttagccttctcgcaatttatagactataaaaataggattactatccacatttatcttttttaattcatccggaacagtaagggtggatcctttttcataaagactcagctcataaggaatgacaacctgcaccaaaccatctttctccatacggccccaaacgggaaagctacgataactccgtgtccccaacataccaaaaagaagattggcatcagaaagtttaaaaatatcttcaggctgctcacattgctccgccagaatcttccctgtttctttatcaacggaaaccacataatgtcctccatcatacctgcaacggaaataataacttcgtggcgtctcaaaaagatcagacacaaaaatatccttatttcctccaaatttttgatgtaagctactgaaatcagtcgcatccaggcagcggatgatttcttggtctgaattctgtaaattcaaaacacaagctggcataattttatgatcggaaattctgaaaacagtatcattacatcctgttttaaacagtaatgactgctgcttacctgaataggtagctgcaatgcctatagtaaaacctgctttctccggaggaaccagtggcgaagtaaaatcattctttacagcaatagtgtccccttgctctgtgaatatgcctaagccataactcccgctccgaaaaggaatatacggaaatgccaccgaagcaaaacagtcttgttccaccttacgctgatatactatctgataatcatggttcaaattttgaataaactccccctctaaggtgtagacccctatctgattagcactgaacaggtaaagacgattattttcctcatcggcctgtatacctgctaaaaaattactgaactcccccggtccttgtccgaaaggaatcaatgtctttataaaatgacctttccggtcaaactgaacaatccgttgttcttttacgggagaaacatagatgtatttgcttgtcaaagcatattcggatactccatccaacaaagaagcgggatcatcggttgtttccaaaggtatatattccacactctctacctcatcttgcagattgagcatagaaggatgatctatcccctgtcgcaagtccaccgaaattaattctccggaaccggaatgtccggagtcacaagctgccatcaaaggcaacaagcaaaataaatgccattgtttcatagattcaatcagtttttcaggaaaaaaatatttatttcccgaaacaaagatatacaggaatccatgatttatgagaataaaacagaataagttttgcgacgacacaaatccctgattatctttttattgcagataatcagggattcattttgcgacaactacaaagtttttttagcccatttttacaattctattgtcaattccaccggacaatgatctgatcccaagatgtcagtatgaatctgagcacctctcaatttatccttcaacgaatcggaagtgagaaaataatcaatacgccaacccgcattcttctcacgggctttgaaacgataggaccaccatgagtaaattccctcttgctccggatagaaatagcggaatgtatccgtaaaacctgattcaagcaaagtagtgaactttgcacgctcttcatcagtgaaacctgcatttttccgattcgttttaggattcttcaaatctatctccttatgtgctacattcaaatcaccacacacaattaccggttttttctcttccaatttcttcaaataagcacggaaatcatcatcccatttcattctataatccaagcgtcgcaattcttcctgcgaattaggagtataaacagttatcagataatacgattccagttcaagcgtaattacacggccttcgtgatcgtgctcttcaatgcctaaaccgtatgtaacggacaatggctttactttagaaaaaatagcagtacccgaatatcctttcttttcagcataattccaataggactgatacccttcaaattgtacatccagttgtccttcttgcatctttgtttcctgtaaacagaaaaaatcagcttccaaacgattgaaagcatcagcaaaacctttatcgtaacaagctcgcaagctatttacattccatgatatgaatttcaacatgattcttttattatttttaaactaacatattccagaacaaaagtaagcacaaaagcatacttatcaaagcaaaatatcttaaaacaaaaaagcgctctgtttcactgataaaacagaacgcctatccttattaaggaaaatgctctctttaattactgtgccgaatcacccggagcaggagtctctgcagcatcatttgtctgcggagcagcaaaacctgaaggtgcattcaacggattggtagctccctctttcaccgcttcttccatgatgatagaagaatctgtatgagcagtaggaacaaaataagcggtaagcacgctacatgctaccataaaagcagctaatccccatgttaatttctcaataaaatccgtagtcttacgaactcccataatttgatttgaagaagcaaaactagaagccaaaccacctccttttgaattctgaatcagtacgacgaaacacatcaaaagagctgcaagcacaattaatccaataagtaataaatacattttctttattttgatttagtgttaataatcaatttctccaaaaatcttatttggtctgcaaagtaagcgtttttttttggatatttcaaatttaattttttaataatttccagagccttagaatatctttgctgtttaacgtatattttggccaatgtttcggtaaaatagctttcatcttctatatcttcctccgcttccggttcatcctcttcgggcatttcctttttcaccggcacttcctcttttatccctaattgaggtaataaaggttcctctgcagacttttcaatgaaatcatctatcagactctggcctttcatccgaggaataccatcatcggacggatgctcttcttcatgtaataagaaagaagtataatcggctgttacatccataggtaactccacggcagcagagtcctcgggtaaagaagacagaaaagcatctatcaatgaaagagtacggtccaatccgccttcctccttaggcttctcttgcttgtcaagaggagaaatgataaaacgctccccttctatcagataaaaaagaactttgcgatcggccacatacaatgcagccttacgcaattcttcaccgaatgttatatcatgcagtaaaaacagattcttcagataaagcaacctcaccgtctgaaaatacggataacgcgcaagcaacgtacgcagctcgtatagtgtatcccgatttaataattcaggatgggttatccattcatataattgctgttgtgtcatgacggaaaagggctcactaccagtttgccacggtagcattgaatatttgctctacaatttctttaatcatctgggttactaattcatcctgtacagcactcaactgctgattagcgttgtattctcggctagccgagaattgttgaccattcatattctctgtcggattggaattgttgacaaagttcaccctaaccgtcatacgcaattccaccatgctggaataaccgtcagaaccaattcctttattcaaagcatcataattggttatttcccctgacaattgcaggtcacctccacgcttggcttgcttcaaccgggtctgctgcatataaatatcctgcaatgccgtattgaacatgctctccatcggtccccacacaaaacctgccgaacggttcgggaagttttcgaacgaaatagtctttaccttagtatagtctatagacgatccgttaaacttataagagatggaacaagcagttactattcccgccagtaccatcaacacaccaactactttcaattgtttaatccaaaccatattcttttatttttctataaagtgtgcgctctgaaatattcaaatcttttgccgcattctttcgttttccatgatgacggtcgagcgccttacgtatcatttctttttccacttcatccaatgacagtgtcgcttcttccacaaattcctccgtgtcctgaatatcatctactacaggatgcacggatttagcggcagagataatggtaggtgtagcaggcactactgtagcgaccaaattccgttgaggttcttgataataagaaactgctgtagtagccggtggcggaacaggttgcgctccacgttccgacatcaaggtgtttaccaatttcttcaactcagttacatcacgccgcatatcaaacagcacctgatacagaatctcgcgctcactttcaaaagccttccccgcacttgctttcacaccaaataaagcgggtaaaccggagtttacacgttgttccggtaaataatttctcaaaatttccgccgtaatgtcgcgattggtttcaataatagatatctgttctgtaatattcttcaactggcgtacattaccgggccatgggtaagccaacaacaaggcttttgcatcttctgtcagctgaatggccggcatacggtacttctcagcaaaatccgatgcaaatttgcggaaaagtaatgttatatcatctccacgttcgcgcagaggtggtatcttgataggcacagtgttcagacgataatataaatcctcgcggaaacggccttcggcaatggcttccgtcagatttacattggtagcggcaacaatacgtacatccgtcttttgtactttggatgaacctactttaatgaattcaccactctcgagcacacgtagcagacgcgcctgcgtagcaagaggtaactctcccacctcatccagaaaaatagttccaccattggcttcggcaaaataaccgttacggtcactgatagctcctgtaaaagcacctttctcatgtccgaaaagttctgaatctattgtaccttcaggtatagctccacaattcacggctatatactgtccatgtttccgacggctgaactgatggatgatctgcggaaaattttcctttcccacaccactttcaccggtgatcaatactgataaatctgtgggcgccacctgaatagccacgtctatggcacggttcaatccttcagcattaccaataataccaaatctgagtttaacattttgtatttctgacctgaccatattcattttattatatgacaaaattacaaattcccgagcagacagcaagtaattatggcagaaaaataaaaaataaggcgcggatttcacggattgatacggtcttttataaagagaaaccgtaaaatccgcgcaatccgcgcctgaataaaaacagtctgttataaattaatcaatttcctgatcagcttcataaccacccatttcgcgaatagcattcttcaagatagcatactgctggaagagatggttgacaggtatttcattttctgtataatcatgcatcgggctcttcaagaagaaactcaagaaacgctgtataccaaaacgtcctgcacgtgcagccaagtcactcaataatactaaatccaaacataaaggagcagccaaaattgaatcacggcaaaggaaattaatcttaatctgcatggggtagcccatccatccgaagatatcgatattatcccaaccttccttactgtcattacgagggggatagtaattgatacgtactttgtgataataatctgtatataaatcaggctggtcttcgggtacaagaatcgactccaaagtagacagcttgctgacttctttagtacggaagttagccggttcgtccaacaccaaaccatcacgattacctaagatatttgtagaaaaccagccggacaagcctaagcaacgggttccgataatcggagcgaagcctgacttaaccaatgtctggcctgttttgaagtccttaccagcaataggcatcttcgttttttcagccaattcccacatagccgggatatcaactgtagtattaggagctcccatgatgaaagggcaaccttctgacagcgctgcataagcatagcacatagacggagcaatgtgttccttatcatcctctttcatcgcttgctccaatgctgccaaggttccgtgtactttttcttcaacaggtacatagatttctgtagaagcagcccaaagaactacgatacggtcgcaattattttcagctttgaaattgcggatatcttcacgcagctgttctaccatatcccaacgattcttgcaatctttcacattatcgccatccaaacgactagcatagttgtgatcgaaagcagctttcatcggaactatcttttccagttcttcctttacaggaagaatgtctttttcttgtaaaacttcagcatttacagctgattcataagcattagcaggataaacatcccatgcaccaaaaacaatgtcgtccaaagttgccaatggaacgatttctccataatgcaaatactttttattttctccacggccaacacgcattttatcatattgagtcatagatccgacaggttttgccagtcccttacgagccatcagcacacctgtcataaaagttgaagtaacagcgcccaatccaacacaaagaacgcccaatttaccggttgccggtttcacattcattttttccattctaatttctttgttaaaattgcatctcatagcagagattaagataatttgtgccaaagttacaccttcttttgaaaacttccatgctttttctagttttttttgtagctttgcaaccgtttaatataaataggtatggatgatatttgttgcataggccacattacattagataagatagtaacacccaggaaaacgacttatatgcccggcggaacatcctattatttttcacacggaatcagtcatttaaaggatacaaagcattatcagctggtcacagcactagcgcccagtgaatttaaagctgtagaagatatccgtgcaaaaggtatcagagtcactgttattcccagtcagcgaacagtctatttcgagaatacatacggggaaaatcaagataaccgcagtcagcgggtattagctaaagccgatcctttcacagtggaacagctacagaatataaatgcccatatttttcatttgggaagccttctggcagatgatttttcactggatgttgtaaaatatctttcagaaaaaggtattttggcggtagatgcccaaggatatttgcgcgaagtccggggtgaaagagtttatcccatagattggacagacaagttggaagccttaaaatatattgatattctaaaggtaaacgaacacgaaatggaagtgcttaccggtcacaaagacataaaacaagccgctttgcaacttgctgaatggggagtaaaagaggtattgataaccttgggaagtctgggttctgtaatttatgcagaaggtagatttcataagatacccgcctatcctcctaaagatatagttgatgctacaggatgcggagatacgtatgccacaggatatttatatatgcgcaacaaaggagtatcctatgaaaaagccggttgttttgcagcagccatgtcgacactgaaattagaagcatccggtcccttcagcaaaacagaagaagatgtatgggatattatccggactagtcctttgaaagccgaggaaatttaaaaatagatagaaatcccgataaagccagacagccatatcgggatttttaatttcagtttccttctacatcggcataccacgaatagaataatacaacacaaaaagaaacaaatggtataatgaatgataaggacatattactattgtctgccacatatcccatcaacacagggccaatagctcctcctacaggagacatcattaaaaaagaagaggctcgtttggttttatttcccaaccctttcaaagatatggcaaaaatagtgggaaacatgatggcttcgaacacatataccaaaaacaaagcaactaatgaaatttttcctaaattgcaaacgataagaaaagtagccgctaccgttcccaaagcacagtatagcaaaactctttctgcacgaattcgctgcataatccaactaccggcaaaacgtccgcacataaataacccgagcccaccgaatgaaagcactactgccgcatcacgggcattcatccatccatcgtccaccacataattgataaagaaactattgatagaaatctctgctatttcataactgaatagtgccagtagaccaaataaaaataatttatgcgaccataagccttttttaactgtctttccattcaccacattgtctgtatgaacaatctccggaagtttgatacgggaaaagaccagtgccactatcagcacaactacccccatcagcatataaggatatgaaatattcgcctctcccttctccgagaacaacaatagtcctcccaccaaagggccgcaaatacatcctaatccattaaaggactgggccaggttcaaccgactggcagctgtttccctatcccctaattctgtcatataaggatttgcagccgtttccaaaaaaaccaagccgcaagcgatgacaaacaaagagaacagaaaaaattcaaatgacatccagtattcgccgggaataaacatcaacgacccgatgccgtaaagcaataatccgaaaacaactcccctacgatatccatatctggtgatgaataaccctgccggaacagccattacgaaataacctaaataaaacattacctgcaccattgccgaatgagtacgggtaatatccatcacctcttgaaaatgtttattcagcacatcaagaatagcatgtgcaaatccccataaaaagaataaagaggttactaaaacaaaaggaactagatagtccctttttaccaatgcatgtctttgtgtctccatactttttataatagaacaggcagttgggccaaattcgttataatcacatcaggaacagattcgtcaatgacttctcctccccaaccttctcctttcaaccaagctacacgacatcccaccgctttggcaggaacaacatcttttgagaaagaatctccaaccaccagcacattctttgccacaaatcccatagcatccactccgagtctgtagatagcgggatctggtttacgaacacccaccacagaggattcaataatttcatcaaagaaatccagaagtccaaaatcctttaaaatggtctgaatattaccataaaaattagaaaccagcactaacttatattttttggacaactcttccactaccggacgtgtaacctgcaatatatccaatacatactcataacagctgtctgctactttcgtggcataagattgcagtttcaactcatccataggcaactttctctgttctgccaaccattccatctgaagtttggccttaatggaaagtacatcatgaaaatcatgccaaggctggacaaaagggtatttagccaacgctctttctccaaagacgtatgcctcacgaaaactctccttatccaccggaatctgatgttccacatacttggcccacaatacttccgcccagtgacggctattcgtatctatcgtaccgccataatcaaatataactccctgaatatctttcaatgcgttcattatctcatgctttattagtaggtgtaccgttgccgactttcatcaacaacacaccaattacaatccaaatcaattcacgtacacgggttatcaatccggtataaactccgaaagctcccggaatagccagtcctcctaccgctaaagcaaagcccccctcacgagcgcccaattgcataggcgagaaaaagaacaaattagcaaataaagaagtaaatgccataatcagaatacaagccggaaagctaacatctgttgtcagaatattcaatatgaaatacacttccaggcaacctagaatccgagccatgaattccagacttaacgaggcataaaatgtagacttacgctgtttgtgcagctctgctatctgactgtccacacgttccaaagtctcccgtttgttttctgaaaaacgtttggcccatcctttaataaaaggaatatattgtaataattttaaagtacggacagccattccattcttgtatcctttcataaaaaaataaatagccaaaagagaaaccacacccacaacagccagcatagtccccatggcaatatctaccgggcgtaaagccaaatacaagaaaatagaacaaaaccaaaaacaaaaatgcgagaaaatatgcatcatcacataaaggataactgatgatgttgccttactggccccgacataaggagtcagttccatgatacggtaaggttctcctcccattaatcctaccggagtagcataattcagtgcaaacccggaaactgtaagcttataaactttccaaaacggaataggcgttcctttttttccatctcggataataatgtaccaagaaagggtattgaacaagtaaatgataatccataaccctactacagccggcagccaaatccctgcccggcgcaagttagccaacaattcatcatactccatatcaaaagtacagagcattaccacgatagctacaatcccaaatatcaggaatatatttctatatttacttttcacttcgccgcgtatttataatataactgtgcgcaaaccgcctcgtggcaatggcgcatatatacaaataaagaagtcattacaataatctcgaatacaaaatacaaccaaggttcgccaatcagcaaactgatatacaaagcaatggcacgtgtattaaaagtcaagatattggtatatttcatcaaaggtttgctagctgcacgaaattcgttccgcaactcctgtggaatattgtccccatacttttcctttaccaaagcatagaaacgctgaaaattaggggtcattctttcctgctgacgtgtgtaattaccataaaaatacaaaaaagctttccaccagaaatttcctttccaaggtaaactataaaagatctcacgctgttgtttgaaattatccagctcacttccatttttccctttcagaaaatataaatgaatattacgataataatccgccaatgtacattgtttactatgacaaacagtgcccgaaaaagcagccaatatccaaataaaaatcccccaatgcatcccgtcaccaatatgaaacggcataggctggtccatcagtctgagacagatcgccgcataaatagtaaagaaccaaatatcaccggcaaagccatccaacatacgtccccactgggttttctgccctgtaagccgtgccaattggccgtccgcactgtcataatggtttgcccacatcaatagaagtataccaatcagggtatgtttcatatcggggtaatagaacatcacgcctgcgcctatacctagaataatagaaaaaatggtcacgacattgggatgtaccttcaattttttaaacaatagcgcccatgcatatcctatgggacgattgaaataaatatccaggaactcctctgtgtccatggatttgaaagaagcctctattcctttcttctcactctctgtactcatgtctttattgtttcatttgctttttagcccggttataaatgcactctgcaattttacctcccgcttcctcacgacaacgggcaaagctgggccaatcattaaaatctataatccgcagtgttccgtcggctgaaaccacacaatcacctccgtaaatgggtacgttcagcgcctcagcagctttatcactttgtattttcaattcctctacgctaaaaggaatccctttggctattccgtttattttttccaaaccgaacttactgtgcgaacaaggagacggataaaaccaataaaagaaatcagtgccgtgtaccccatagaatttcaccaagtcgccttgcaagtgctcattgatgaccgcaacaggaatgtcacggttgcgaaaatcagccagaatattctccacctcttccttacaagtggcataagctacatcttctttcaccatagcatgagagtctccccgctttacccaacaaggataacagttttcagaatactcgtctgctgtggaaataataaaactctgcggatgaggaactcctctttttataagtagctccgtcatgggtctacgtacacaattatctataccgtaagcagagtttatcaccaacgcacctccatcctccaaagacttcaagcgggctattgttgctttatcacgggccatatcaaaaatgatatctcctttgacaccctgctccacgaaatccttctcggcataaacctcaacttcacagcccaattgtcccaactcttccaccaccttattaaatatggcggcatcattgtccacatgattgggtgaatattcgtttccacggcttacccctattattgaaatcacattcattcctttatgttatcttttaaattactcgtccttaccggtcagaaagttttccgctttcactatatcactggcatggtctacatccagaatttttgtaaaaggataagcctttaatttcaagccgtcggccactaactgcctctggaagttgcgcatacgggacatacctttttccatacacccgtgcaatgtcttgaccgctgtcggagtcaggcagtaaattcctcccgatatatagcggcatccggagatggcctcatcatgaaagccagttatgttcaaagcttcatctgtagaaatgtaaagcggtttttcatcgtctatgaaatcggtcaccgccatatatccatctttgtccgattgtttgaacgcttcaataaaagtcgagaattcttcttcacggaatatggtatctacagtagtcaaacagaacttatcgtctttcaaataagagttcagttcataaaaactatgcattgaactaggcgtagttttcacaactacttccaatggcactgtcgcttccgcctgtagttttgccaaatgctcttttgtcaacggactttcattattaataatgatgaccaccttatcagccccgttgcgcacaaagatctgtatcagacggtcaatcatggcaactccgttcagttgcaccaaaggtttgggtaaagctaccccttcttgtgaaagtcgggagccttcacccgctgatataattgcaaatttcatttctactctttttcttgaaattatattttagaccggttcaccatcaatcttcatcatcaatggtatctaacttcagtttatcgctatcatcccgtttctcataatactgtttacgcaatggatgtgcatggatatctttttcgacaatccgattacggaaaacatccatagccacatagatagcctggcgaaaagaatcttccaaggcaaccccttgtccggcaatatcatacgcagtaccatgtgccggagaagtgcgtacaataggaagtcctgccgtgtaattcactccttcatccattgccaaagctttgaaaggagccaatccctgatcatgatacatagctagaattccatcaaaatgagtatagttgccagatcccataaagccatcggccggataaggtccgaaacactgaatgcctttggcaaccatttccttcattgccggaattatgatatcactctcttccgtaccaatcaatccctcatcacccgcatgaggatttaatgaaaacacagctatacgcggactgtcgatgccaaaatcctcttttaaagaacgatggaaaacagccaatttttccataataagttccttggtaatatcttgtgctatctcgcgtacaggaacatgaccagtcaccaaagctacccggaaatcattcttcagcaaaatcattaacgctttctgtccttcccccacacgctcttcaatatattctgtatgaccggggaaatgaaaagtttccgactgaatggtatgcttattgataggagcagttaccaaaacatcaatcattccctcccgatagtcctgcaaagctctctccaacgcatccaaagctgctttaccagcttccggtgtcggtttggagagctccaccttcaattcgtcttccgtacaattcacgatgctcagtttatccggctgagcatcatctgcagaattgacaatactgaaatttgtttgaatatccattgctttacgatgataagcagccactttaggtgatccataaataatgggtgtacaaagttccagcatggtaggatccgaaaaagttttgagaattacttcatatcctactccgttgatatccccatgagtaataccaactcgtatcttgtagttatcttccatctatattatatattataatgtctcttcttactttacccggcttgttgtatctattttttcttccggaatattaccactaattacaatttcgtcaatcaagctttcattgggcaatctcaatgtataaagtgaagcttccatctgacgcatcagattacgtttcaatttatccggtgaataaataaaggcctcaaccacaatgacacgaccgttagcacgatccacccgtgcatgagacacaaacggacctcccatcatgtcaccttccatttcccataatccgcgagcttcttgcgcatactctccttttacaacaatatcttccacatccacaaacatagagtctgttgccatatacattccttcgcgttcacccggaatatttgctttcattacagaatcacgtttatgaatgaaataatctttagtaaaggtatccttgtctgtataaggataagagtacattacaaaattcatatccgctgtagcacgattagtagaagcccacaaaaaatctttgccttctttatagttagccagttctatcggcacccagatatcacaatcaaaaatacttcctaccttagtggaaatcacatcgctatgtttttgtttcaacaaagttatctgacgattcatctcagctttcacaaagaaatctataatcactttactgttctttgctacaaattcctcaaattcgtcttcattaggagcctgaattgtcataatcatctgcggagacgcataaacatcacgggaaaacttaagtttgggctgagtataaatatcttgaatatccacaatgatgatattacggaatattttcagcacacggtcaaaatgctgagggtccacatttgatatacgaaacgaacgctccgcctggggtagtccgggcacattggtatccaatacatcaaacaatgcacgtcctgcaggacggtcccatacaggtttatttactacgaccaatacttcgtaaggtctaccgctggacgtgggggtaaacaagttcttttgtcccttcttacaagaagccagtaccagaaccaccagcaccaaacttaaataaaatgctattcgtttcataattatatgatattattgtttagtttactgtaatgtaacacctttctctttctgttgtttagctgtagacaacattccgcaagcggcaaaaatatcctctcctcttgatgcacgaatggtggcaaatacgccatgttgcgtcaaataatcacggaaagttgtcattgcttccatatccaccccttctaaatcaacatcaggaatagcatgaaaccggattaagttgacacgacactcaataccccgcaagagtttcactatctctttagcatagatcagtgaatcgttcactcctttgaatacgatatattcaaaagacagacgacgctgtttgctaaaatcataattatgcaatatatcaataatttccgtaatggagaaagctttctcggcgggcatcaaatcccttcgttgcgaaggaatcggagtatgcatactgatagccagatgacaatcactttcattcagaaagcgctccagtcctttctttaaacccacagaagaaacagtgatgcgtttcggactccagccgtaaccatattctgaagtcaggatctcaagcactttcaacacctcgtccaaattgtcgaaaggctctcccatacccatgaaaacaagattagtcagcttttccctttcggggatagaatagatctggtttaatatttgattggctgtcagattagctgtaaaaccctgtttcccggtcatacagaacttgcagttcattttgcatcctacttgcgaagaaacacaaagagtagcccggtcctcatcgggtatataaaccgcttcaatgaaattacgggttggcgtacggaaaagatatttcaccgtaccgtctaccgaacgcatttcttccaccggggcagatgcccccacctcatacccttctttcaacgcttcgcgatgctttaatgacaaattggtcatctcgtctatcgtttccacctttttatcatacaaccaagacgcaatctgctttgcggcaaatttaggcattcccagattcctcacaatctgttgaatctcatccaatgtcctgccaagtaatgctgttttcggagtttccatttatatttaaaagacaattagcgtacaaaggtagagaaaaaataagatatattacctatctttgccgtgagaaatactttttaacaatgagaaaaacaattaattgctttattccttatatggaaagcacagcggcagaacagacaatccatgctctaaaagaaagtagcatagtcaacaaaatctatctgctgaacattgaacccaacaagacattatccacacccgatggatgcgaaatattacctattgattcactaaccagttctaagacaatgaagatgattgctgaaaaggcagacacaccttatatcttgctctacaccaaaacttctgctttggaactggcttacaaggcactggaacgcatgactgacttcctgcaggacagagaatgcggcatggtttatgccgaccatcatgaatggaaaaacggagaaaagaagaaacatcccgtcaacgactaccaacctggcagtgtgcgtgatgatttcgacttcggtccgctactgatattcaacagaacggaattcatcctcgccagcctccaaatgacagaggaaagaaagtatgccgccctttatgaactgcgcctattccttaccctccattctcatctggtacatatcaacgaatatctttatacggaaacagaaagcgacaaccgcctgtccggcgaaaagcagttcgactacgtaaatccccacaacagggaagcacagatagaaatggaagaagtgttcacactgtacttgaaagccatcgatgccctccttgaacctatgtatgtggaaacggatgtaaagaaaggaaatttcgagtacgaagcctccgtcatcatccccgtgcgcaaccgcgcccgtaccattgacgatgccatccggtcggcactctcacaagaaacacgctttccattcaacatcatcatcgtggacaatcactcgacagacggaaccacagaaatcattggtcaatacaaggagaacaaagcggtaatccaccttcagccccaacgtaccgacctgggcatagggggatgctgggacctcgcaatcaaccatccccggtgcgggcgcttcgccatacagcttgacagcgatgacctgtacagcgacacccataccctgcaaaccatcgtagacacgttctacaaagagcaatgcgccatggtaataggaacttaccgcatgacggacttcaggctgaacaccatcgccccgggagtgatagaccatagcgagtggacgaaaaagaacggacacaataacgcattgcgcatcaacggcctgggagctccgcgcgcattcttcacacctatcctgcgcgaaacaggcgtgcccaatgtcagctacggagaagattatgccctgggactcattttctcgcgccaatataagataggaagaatctatgatgtactctatctgtgccgccgctgggaagggaactcggatgctgccctgagcatagagcagaccaatgccaacaatcactacaaagacagcctgcgcacccgtgaactgggaatccgcaaaaaatatacagaagagctgaagaaccggaatgaaatcaagcgatttatagacagccaactggcgtgctggccactggcacaccacaaccacgaggcattacagactgtacagaccaaggaactgtccataaacggctacacgtttgtggtacagtgcaatacacagcgtgcggtttcgactaccgccaaagtggataaggacagcatccaagcacgcccctgtttcctgtgcaaggaaaaccagcctaaggagcagaaagcactggaaaccatcactgcaaacagaatatgcgttaacccttatcccatattgccggatcacctcactatcgcccataaagatcacatcccccaactcatggatgagaatattttcagttacgatgacgtccgtgcattcgtacagaaatatccggactacgccctattctataatggagcacattgcggagcctctgcaccggaccatctccatcttcaaggagtcagaaaaactgatgttcccatcatcccgaacgtacaacagctgataacccacgcacagacaatcgatatacgcagcatgtattttccctacctagaagaagaggaagattatccactagaatgtagccgaatttacctcaacaccaaggactatccctgtcctttggtaatcctctcaagcaacacgcattatgacgactccctgttatacagcgccctcgccgctttcccaccggatgaagacggacaagaagcgaagttcaacctgctgttatggaaggaaggccatctatactatacggtggtttttccccgcagcaagcaccgtcccgactgctactttgcaaaaggcagcgaacagatgctcatcagtccgggagctttggacatggctggcgtaatcgtcaccacccgtcaggaagatttcgacaaaataacagaagaaaaagtggcatccatcataaaagaagtgggaataacagtagaagaagccgagaagatacccggacgttattttgacgagaaagcaaaaagatagagagaacacgaagagatgaaggaattacagcaagcccataaacaagacgaataacaatgaaagaacccgaaataagcgtaggaatagtaaacgcacaagaaattcatttttcactgaacggcaattttttcgctaaaggagaaacggtctgtggtgaacaacaagtagccttcagcgaaggaggtattctgtggaatggtaatctttaccgcgaactgaccttcactccacaagacgaacatgcctcgttttcattatatgacgtaaccatcggaattaatttccactgggaacggcaagaaacccaaagttttatgggaacactgaaactagtggtggacgaaggcaaaatcaccgctatcaatattcttcccgccgaagactatttgataagcgtcatctcttcggagatgaacgccacctcctctttagagtttctgaaagcacatgccgtggtatcacgcagctggctgtttgctcaaatagagaaacgcaaagctttaagtggcaaaaatgaaggtttcttttcctttatcaagaccgataccgaatatatccgttggtacgaccgggaagaccacaccatattcgacgtttgtgcagatgatcattgccaacgttatcagggaataaccaaggcatccagtgctgccgtaactgaagcagtacaggcaacccgagggcaattactaatgtatgaacgcggcatctgcgatgctcgtttctctaaatgttgcggaggtgcaagtgaggaattcggctattgctgggaagataagaattatccctatttgtctaccatccgtgatacggaagaagaagaaaaccgtccgttacccgatctgactaaagaagaagaggcagaacgttggatacgtacttctcccgtttcgttctgtgatacccacgataaaaaagtaatttcacaaatactgaacaattacgatcaggaaaccacagatttctatcgttggaaagtgcgttattcccagtcagagctagccgaactgatccgtcaaaatacaaaatcagattatggagacatcatcgacctgattcccatccaacgtggcaagtccggacgtatctgcaaactgaaaattgtaggttctttgaaaacattgactatcggaaaagaattggagatacgtcgtaccctgtcttcgtcccacctattcagttcagcctttgtagtagataagggagaattgaaaaacggcgtccccgaatggtttctgctaacgggtgccggttggggacatggagtaggcctgtgccaaatcggggctgccgtaatgggggaacggggatatacctacgacgaaattctattgcattattataaaggtgcagatatccgccgtttctattaaccgatccaccaagccatgcgccggataggatttccatccggaatctttaaaatgaaaaaggaataatgaaaaacaaacatacttcaccgtgggcatggatacccacgctatactttgcacaagggctgccctacgtggcagtgatgactatttcagtcattatgtataaaagattaggaatcagcaataccgaactggctttttataccggctggcttaatctgccctgggttatcaaacctttgtggagtcctttcatagaccttatcaaaacgaaacgctggtggatcgtcactatgcaactcttaatgggtgcgggactggcaggcatagccttcaccatccccaccgaacactttttccaacttacgttggcaattttctggttgttggcattcagctctgccacgcatgacattgctgccgatggtttttacatgctggcactggactcgcaccagcaagctttatttgtaggaatccgcagtactttctatcgcattgcgactattgcaggacaagggttgcttatcatgcttgcaggaagactggaaattgtaacagacaatataccttacgcctggtccatcaccttttttgtattggccgggcttttcctgggagtgtggatctatcataagtttattcttccccatccggattcagaccatgcagccaaagaagtttccgcttctaccctactcaaagaattttttggcacttttgccagtttctttcagaaaaagcaggcaagtattgctattctctttatgttactctaccgtttaccggaagcacaactggcaaaaatgtgtattcctttctttatagatcctattgaagaaggtggtttggggctcaccactgaggagataggtttcgtacaaggaacagtcggcatcatcgggcttacccttggaggtattttaggaggaatagccgtagcccgtaacggtttaaaacaatggttgtggccgatggtatgggctatttccttacctgatttagtctatgtttacctcagttatgtccaacccgattccctataccttatcaatatttgcatttttatagagcaattcggttacggattcggtttcacagcttatatgctttatcttatttattttgcggacggagaacataaaacggcacattatgccatttgtaccgcatttatggcattaggcatgatgattcccggaatggccgccggttggcttcaggaccagatgggatacaaccatttctttatctggattatgatatgttgcgctgtaacctttggggtgacggcactattaaagattgatccggaattcggcaaaaaaaaagattgatgccgatgatgaagaatacatctacaaactgagactttgccctctttctccaacagagtttttcatttctgctaccactactgagcttttatcagaagtaacaatctagatataagcatcttatagaggtggtggcagcagtattttttagatacccaaaaggctgccaccacctcttataatacttttctcatcaagactcgaattattcccacaaaaaggaacatatatttagaggaattcttccgctccttttgaaaaaagataaggaacttccgaacaatacatgcttatcttctgatacattcaaccgcatgatgtttcggtttcaacttaatggaacagtctgaaacaactcggcatgtagaatgaatgcagtgtagtttaacgctttaggttgactactctttcatcttacttgtacggatggttgacagagataatacttagttataatatcagttgactctttcaagagttatttctttgccgggttgacaatcttcctgcaattactattatcaaaaagaatatcctaaaatggtggcagtaacattttccatcccttcaaatattctgctgccatcacccctcaaagcctttatttatgagcattccagacaaaaggtggcagcagtggcagtagaaaagaaactctatagagaaaaaaataaatagaagttcacatagcccccggaagaaaaaatcttttttaaaagatagaaagacagaaaataatgctatacttgcaaactcaagccaaataaaacagactagaaagaatatgacaaggaagagttttaacctaaaaaataagataaagtcctctcaacaaaacagttattatatttgtttcatattcaaacaataacataaaagatacatatatgaaaaagattattttattagtattcgtcaccttgttttgctgcgtagactactcacaagcacaaacaacagaaaagaaaatgacacgtcaggaaaagaaagaggcgcaaaaagccatggaacaagccttgttcgaagaagccagacaagctatagaaaacaaagctttcacactggaagctgaccgggttatatttaaaagaggcagaaatgcctttgtttcttctaataccaattttgtaatggtagacgacgatagagcatccgtacaggtagcgtttaacattcctgccagcggccctaacggattaggaggtgtcactgtagacggcaatgtttccggttacaagatcaaaaccgacaagaaaggaaccatgtatctgacaatgagtgtaatgggggtgggtatatctgctcaggtaagcataacattacctcatggaagcaacaatgccaccgtagatatacggcccaacttcaattccaaccgcctgactttatccggtgaactactgccgcttgacaagtcaaatgtatttaaaggaaggtctttctaatcactttatagttcatagaacataagccccggaaattttgttaaagcagatttccagggctgtttatttcccattcattcctcttcacacttttaatttcagttcttcaaaaatacacttcagcaaccggtttttccgtttcagtaacaaattactacctacttatgccaaagcttattatgtttgtaccggatttcaataggaaaacaacataaaataaaaaagtaggtattatgagaaaagttgtaatattaacattagtaaccttgtttacctgcgtagagtactcacaggcacaaacaatagaaaaggaaatgacacgtcaggaaaaaaaagcagctcaggaagctttggacaaaatgttatttcaggaagccaaagaggcaatagacaaccaaacctttgtactggaagcggacagagtttactttaaatacggaacctccgctttcgtttcatccaacaccaactttgtaggactggacggtgacaaggctgtagtgcaagtagcattcaatgtacctttcagcggtccgaacggactaggaggtattaccgtagacgggaatgcttcgaactataaagtaaaaaccgacaaaaaaggtaatattcatgtcagtatgaacgtgatgggaatcggaatctcagcccaagtaagcattgatataccttatggaagcaacaatgcgactgtagatattcttccgaactttaattccagccacatgactttatccggtcaaatattgccattaaagaaagccaatgtgtttaaaggacgctcactataaactacttaactaaaataataggaatatgaagaagctactatttccactattcatgcttgccatgatagttacttcgtgcgagaaagatccggatatgaataaactggatagtgactacagcgtttacaccgattatgacaacagtgtacatttcaatgagttttccacctattatctaccagatagcattctggttccggacaacagcctgaaagccaattattggaaagatgaaaatgcccaaaacattatcagtgcagtagcccatgaaatggaacagaaaggctatgtaaggacggaagataaagaaaaagccaatgtaggcattcagttgtcatacgcccaacaaagaatacaaataaccacaggaggatggtatggcggctggtgggatgccggattctggggaccttactggggaggaggatggtattatccttatccggtaacttacagctatgacacaggaaccctgattatggaaatggttgatttaagacaacctgtcgatcagtctaaccaaaacaaactgcctgtcatctggcatgcttatgcgtcaggactgctatacggaaactcccatttcaatatgcagttgacattaaatgccgtcaatcaggcatttgcacaatctccttatctgtcaaacaaacaataaaaccggaaaatcatgaaaacgaaaatattaaaacacagagctcccaaacgtatcctcatcggagtgttattagttctcttttgtttcacaagtaaagcacagatctgggaaaatgtacatttcaacgtagactggcagatgaatatgccgttgaacagcaactttgccgataaattcagcggatggggaatgaactttgaaggaaaatatgatctgactccctattggtctataggagctttccttaattttcataccaatcaccgatacgtggaccgccagaccatccccctcaccccaacggcttcattgacaacagaccagcaacaatcggcgttccaacttccctttggaatatctgtatcctacaagttactggataacaggtatgtaaaaccttacttcggagtcaaatcgggtgccatgtattctcaaaactccatttacaacaatctggtacaatggtatgaacgcccgtggggattctatgtatcacccgaattgggaatagatattcatccggtaccttatcagcgtctggggtttcatgtagccgtatattatagctacgcaaccaatcaaaccgatatcctgacttattctgaagatggaagaaatagcatgggtgtgcgtgtaggagtttgtttttaatccatactaagcgtttgctcataaaagaggagatttggaaagtattctatttttttctgaatttcctctttttttcatagttttgtaaaataacccaaatcattttcagcagcggaatggctatgcaaaataaatacaatcaattcttcaactttttcctgttttcaggtctggcatgtttctcatacctttcgctggtactatataccgaccttacgcctcaacatcagaaaatattaatctcctttctgggatttatttctgtggtattcatattcaatctggtaggctttagtctgatattcatcaaccgatggctgaaaaaaagctatctattctttatcaagaagagaaacaaactgatcatcaattgcattttgattgcagctattcttttcttcatgaattacgctactctgaccatctgtaaagtattgctggaactgcccttcccatttgtactaagcagtccgggcctgcgcttgatcatgattatatggttggtagaaattgtgattgtgagcctgagtatcatgaacgctttttacaggcagctggttattctgcatgaaaaaacaatgaaactggaagaaagttccatcaaagcacaatacacggctttacaaaatcaattaaatccacatttcctgttcaatagtttgaatactttaatatccgaaatagaatacaatccggaaaacgcagtagtttttacacaaaagctatcggatgtttatcgttatatcctaaaaagtcaggaacaaggacttgttaccttacgtaatgaactggaatttctggattcatatatctatctgcatcaagtgcgtctgggaaaatgtattcaactggaaaacaaaataccccccacgttattgaacaagaaaattccttcattaactctacagttgcttatcgaaaatgtgataaaacataacatcatcaatatggaaaatccaatggtcatccatttggattattctgacaaagatcaaactctttccgtaagaaacaagatcaaattaaaaaagaatgttgcaaaatcaggaatgggactgaagaacttatctgcccgctatctgctgatttgcaacttgcatatcacaattattgacgattctgaatatttcaccgttaaaatacctttgctgaatgaataagataaaagccgctattatagaagatgaaattcctgcaggacgcctgttacataaaatgttgtcaggattaaggccagactgggagatagttgtattacccggcagcgtagagggatctgtaaaatggttccaagagcatccacacccggatataatctttctagatatccaactgaccgacggcatttctttcactttcatagaacagacccaaccggaaagtatgattatttttaccaccgcctacgacgaatatgccatacgtgcttttactgtaaacagcatagactatctgctgaagccaataaacagggaaagattggccgaagccatcgaaaagtttgaaagattaactgccagatatggcaatgccaacctatcgagctcatccaatgaattactgaacttactgaaaaatataagtaatccggaaaaaaaataccgtacccgcttcctgatatcaggagacgaaaagctgtataccttgcaagtagaagatatagcttatttctattctgaaaacaaaattacttttgccgtcacaaaagaagggaaagagcatatcatagatttatcgctcgacaaactgtccgaacaactaaacccagatatttttttccgcaccaaccggcaaacattggttagtgtacatgccatacagaaaatagaaaactattttttaggaaaaataatagtacaggtaaaaccgccatttaaagataaaattactgtaagcagagaaaagatagctgcaatgaagctttggctcaattattaaaaaagtctgtttatataaaaaaacactaacttataagtaataggaacaagattggaatccgttcctattactcaaccaacagttttacaaaagctttgcaatcacaattgtaaaaaacaaatagaactttcagcaggagcctttaaaattacttttccacctcctctcacgctaccatcttcttttataaccgttcctttatccggatcaatccaaaagactttatacgtttctctatctcccatcaaatccaaattaatctcattcttcacacagtacccaaggtatccctttccgacagcccccattacccactgagtatccatatcggtctgtctatctataggagaaaaagaagaagccttctcataaaccggtaattcatcaatcggcggaattttggcaaaagagccacccgccataaatatagcccaattcatagcattacgaggaactctaattgtactaccattataaaccacagctttatcaggatacttacagcgatattcacgtaccgcacgataaacactggcacaagataccgtgcccggatcaatcagtcgcgcatgctggcgaagagccagacttacccctccctgaggttcgtataaagttccatctgcgcgataatgccactgacggatatcaatcacatcaaccattgaagtatgttttttatctttcaagacagaatcctgcacatcttttgttgctgtcaacgccactaactgatggttatcacacgcattgacctcttccaaccaaaagttcataaaattcaatggtccggtatattccaatccaatgctatgtaccacaccattattgtcatggaacacatttacactctgacgaataaatttactgtgatattcacggataaccggacgagtaatatcatagaactgttctgccatatacactctcttgtcccccgaaaaaacagtcttttccgcaaatcccaactgatttatattattagcagagcgccaaggataatcacaccagtgtgctccttcttctatgatattgtgctggttataatgatcatgtaacaaaaccagtccgtctcgatccgccacatctacaaatcgcttcaaacgattccaataccaaggattgaatttattcagatcatatttgcttaagcgatcctgagcttccccctgcccgctacggctataaggcatttcattaaaaggagcccaaacttcagcatcagcatgcatattccgctcatgatcattacgacgacgctcataccacaatcctgtacgatgatgaagcacatgtgctcccgaaagcaataatacttgcgcaacactatctggctcttcggtatatcccgtaccggtgcgtcccggaacaaactgactgagtgatcctttgccctgccatcctgtagtaccgggaatattcttgcgaaaataagttccgttaatgagaatatgatttccccgcacaatccagccatttttcacttgtaaaggttctgccatgaccacatgcttctctttttcaggccgccagttcacttcgtttaaaagaggagcattattctgggttatctccaaaggatatttcactatcatactgtctatccatacatccattcgcatatccggttttaatgactgtacagacatccaatgagcgtactcgggagttggcttcgtagtttcatcagtagtgtacacaaatattttcttttcttccattgaagatttacccatacgagccgccagttgagcataaaaaaaactttccggcttgacaaaagtatgcgacaattcataatggccattaccaaaaggttgcgtccacattccataagcccaattatgagctgtaggaggagtaacacaatgagtctgtgaagctcgtccctgccagcacatagagttagccgccacccaaccggctccctgatctgccatatcccgataacccaattgaataattcctcctgacaccgttattttatccatcaaaataccattagagaagccaccagtagatccactgaaactataaggccgttcggaatgacattgtacaaaagcattaggtccaggtacggcaaccccaactgtaaaatcacggtacccctcttcagaataacaacgctgaaaaagagttagttgtcccaaagtatgaaaagcataacgcctatggttggctatctcggacacgggatgcagaaatttacaatcctccacagtcacctgcatcgctccctccaataccattaccgccgaacctgcaaaatgatgagcctccactcttcgtacccatccatctttcacatgattgaaggtaattgcctgccaacgatggttctcatctttcaaattagtatgatcatattcagaatcgcaacacaaattctctattccgacattattaatcctcccagtccatgaaagaggtaaaatatacccaccaccatacttgggatcaaggctcatggtcaatggtacatctatggtaatactttcagaggtaacagcaaccacagtacgctcccacaccatatcatgacgaccgggagtccatttcgagaaattatattcctgttcattgcccaatctatccgtaccaagcaccgaaagccatccggctgttgatggacggacaatgcgtattttatctcccaccttcaatgttgcagtttgtttcaaaggaataaccgtagcatttacaggtacatactgcccggcaatatgaatagtgtcttccgttttcgcattattataacccaaaacacgaatcaattcatctttcatcggtcccaatgcacgtaaaaccgttcctccatttttatggcatccgctaccacggagaaccactccgtcagcccgcatcaaaagtttacctttcaattcatagttaccgggagctaactgaactgcacctctgaaaccatccggttccataggaagagaggctacataattcaatgcctgctgaataagaccggttgcatctccatccacgacaggaacatatacttttgcatccacccaaggaatgggatactcagattggcgataaccacaaaaagaaaaatcaggtatccgatcgccgttaggatacgatttataaaccagttcgtcggtttcagtaatatgaacaggtgactgaggagtagtcttaaaatgtgcatctatagttgcaaagaggaatactccggcaaaaagcagaagtgtccggcataaattgtgtttcatagtttcatacctaaaaattcgaatacacaaaaatagcagcaaaacagatacactttattgaaaaattggtcaaaattgggtagaaatcgaacaccagactaaaattataactatttgtacatcaaattaaatatagaaacagagttactaaaataatataagagcccgacaaataaatacggaaaacaatggatatcggataaatttatactatttttgtaagactaataatcatcttattatccgatatgatagtaatagcagatagtggttctaccaaaacagactggtgtctgggtaacaccaagacaaacagcaggacagttcgaacaggaggtatcaaccccttccaccaatcagttgatgaaataaaagaagtgattgcctccacactaactccccagttgggagacaccactgaatttacaactatttatttctatggtgcaggatgtattcccgaaaaaacgaatatagtgaaaacagctttggcgcagaacttccccaaagcaaatatccttgtcgaaagtgacttgttaggtgccgcccacgccctatgtggtaaaacggcagggattgcatgtattttaggaaccggatccaactcttgtttttatgacggggaaaaaataacagctaatatttctccgttagggtatattttaggagatgaaggtagcggagccgtattagggaaacgtctggtaggtgacttcctgaaacaccaacttcccgatgacctttgccgagatttccttaaagaatacgatttgaccccagcactgattttagataaagtataccgacagcccttagccaaccgctttctggcgggtctgactccttttcttttcgcccacaagcatagaccagagatgcagaatttattaatttcctgcttcactgatttcttcacccgtaatgtaatgcaatacgaatatcatgatattcttgtacattttacaggttctattgcattttactttcaagaagaagtaaaagaagcagctctaagactgaatgtgtccatcggaaaagttttaaaaagtccactggaaggattaaaggattatcatttcgaagtatgaattttataaaaataaccgaacaaccgtccatacatgaggatttggaacaaaaatccgtcagagagttactggaaggtatcaacgaagaagaccggaaagtagcctcagctgttcatgcctgcataccacaaattgaaaaactagtaaatgaaatagtagaacgtatgcatcaaggaggacgcatattctatttgggagccggaaccagtggacgcctaggagtattggacgcttctgaaattccagcgactttcggtatgcctgatacctgtgtcataggtattatagccggtggtgaacaagctttgaaacatcctgtagaaagtgctgaagataatagtcaaaaaggctggatggaactacaaaagcatcacatcacaaataaagacatcctgataggcatagcggcatcgggaacaactccttatgttataggagcgctgcaaaaagcgagagaacacggaatattaacagcaagcatcagcagcaatccaaactctccactctcgaatgtagcagatatacccatcgaaatgatagtcggtccggaatttatcacaggcagctcgcgcatgaagagcggcacagggcaaaaaatgatactgaatatgataagtaccaccgtcatgataaaactaggcagagtaaaaggaaaccggatggtaaacatgcaactcagcaatcaaaaactagtagaccgaggagtacaaatgctaattgacgaattacatattaataaagcagaagcaaaacaattgctgcaagaacagggctctgttaaaaaggcatttgacgcttacaaaacaaataattgtatcactaaaaacgactgaagtatgaaaagttggaaacaagaagccgtcatccttgctataggcatgttggtgatggggtattttatcaaacagggattggacactttctctggtaaagacagagtagtgaatgtgaaaggtctggcagaaatggaggtgccagctaataaagtaacttggcctttaatgtataaagacctgggaaatgatctcccgaccttatataacaaaataaatacaaccaaccaaacaattgtcggcttcttgaaacagaaaggaatcactgaaaacgaaatcagtatcaatgcaccggaaattatagacatgcaagctgaacgttataataataattcagttcccttccgctataatgtgacctctgtcatcacggttacttcaactaaagtagatctggtgagaaagatgatcagcgaacaaagcgaactcttaaagcaaggtatcgctattaccggtggagattatcgttacaatgtgcaatatgactataccggtttaaacgacatcaagcctcaaatgatagaggaagcaactaaaaacgcacgggcggcagctattaaattcgccaaggactcggacagcgaacttggtaagataaaaagagcttatcagggacaattcagtatcgaggatcgtgatgccaatactccttacatcaaacgtatccgtgttgtaaccaccattgattactctttggaagattaaatatccatttggcgaagcatattaaacaaagcttctttgttcagaggcttgaacaaataaccgttaaagcctctggacattactttccgcttatctttcagaagtattattcaaattatagtaattggtcttttcaaccaaaaaattccgatcaacccaaattatatatgcatccacattatacaatatggtatccgaaaattctttcacggaacacaccttatttttcttcttaacgaactccttttccaaacttttcctctttcttatctcccataaaaaacctaaaagtagaaacaaactaaaatgaacgctaccatattttaataggttaaatttctacaaatgtacaaacataaattaaaaacaacgattatatcccatttaaattttaatcagcaagaaatttcagcaaacttgtttgtgtttcagtattttgttgtatctttgcgcccgaaattagataaacaatataatgtctaacgtaattaactgagaattttaacaattttattaatggaaaatttaaaaaacatcactcctgttgaagatttcaactgggatgcttatgaaaacggcgaagctgtaaccagcatgagccacgaagatcttgaaaaagcttatgacggtacgctgaacaaagtaaacgaccgcgaggttgtagacggtactgttattgcaatgaacaaacgcgaagtagttgtcaatatcggctacaaatcagacggtatcattcctttgaatgaattccgttacaatccagatttgaaaataggtgatactgtagaagtatacattgaaaatcaggaagataagaaaggacagttaattctgtcacacaaaaaagcacgtgctactcgttcttgggaccgcgtaaacgctgctcttgaaaatgaagaaattattaagggttacatcaaatgccgcactaagggtggtatgattgtggacgtattcggtatcgaagcattcttgccgggttctcaaattgatgtgaaacctatccgcgactacgatgtatttgtaggtaagacaatggaattcaaagtggttaaaatcaaccaggaattcaaaaacgttgttgtttctcacaaagctcttatcgaagctgaacttgaacagcagaagaaagaaatcatcggtaaacttgaaaaaggacaagtactggaaggtactgttaaaaatatcacatcatacggagtattcatcgaccttggtggtgtagatggtttgattcatatcactgacctgtcttgggggcgtgtaagcgatccgaaagaagtagttgaactggatcagaagttgaacgtagttatccttgatttcgatgacgaaaagaaacgtattgctcttggtttgaaacaactgactccgcacccatgggatgctttggatgctaacttgcaggtaggtgacaaagtgaaaggtaaagtagtcgttatggctgactacggtgcattcatcgaaattgctccgggcgtagaaggtttgattcacgtatctgaaatgtcttggtcacagcacttgcgttctgctcaggacttcatgaaggtaggtgacgaagtagaagctgttatcctgactcttgaccgtgacgaacgtaagatgtctttgggtatcaaacagttgaaacaagatccatgggaaactatcgaagaaaagtatcctgtaggttccaagcacactgcaaaagttcgtaacttcactaacttcggtgtattcgtggaaatcgaagaaggtgtagacggattgatccacatctctgacctgtcttggactaagaaagtaaaacatccttctgaattcactcagatcggtgcagatatcgaagttcaagtattggaaatcgacaaagaaaaccgtcgcttgagccttggtcacaaacagttggaagaaaatccttgggatgtattcgaaactgtatttactgtaggttctgtacacgaaggtactatcatcgaaatgttggataagggtgctgtagtagctcttccttatggtgtagaaggttttgcaactccgaaacacctggtaaaagaagatggctctcaagcccaattggatgaaaaactgtcattcaaagtaattgaattcaacaaggatgccaagagaatcattctgtctcacagccgcattttcgaagatgctgccaaggcagaagaaagagctgaaaagaaagcagcttctaatgtaaagaaaacaactaagagagaagacgctcctgctatccaaaatcaggcagcttctaccactttaggtgatatcgatgctttggctgctttgaaagaacagttggaaaacaagaagaagtaatcagtttacttcaagataagccaaaaggatgcatttattaaaatgcatccttttttatgccattatttcttaaaaaggaaaatattctatgggatatccgtaataaaaccgtatctttatagagtaataaaatttcgagttagtatttcacaacgacttctcccccgttttcttattacctcattattaattccatacacttccccttagcaggtcggactgtatattactaatttaaaaagaatcaaatggcgaaacctatttcatttaccaaacgagatctggaaaagaaaaaacaagaaaagcgtttagcaaaacagcagaaaaaagaagaaagaaaaaataacggcacatcctccttcgaagatatgattgcctatgtggacgagaacggtatgataaccgatactcctcccatttctaataataaaccacaagaagtggatatgtccaccattgaagtttcaactcctcgtagaactgaagaaccgatagaactagtacatgaaggaagaatagagcacttcaatgtatccaaaggatatggatttgtaaaagatttgaagaatgcagagaaatacttctttcatattagtggactgatagacaatatcatagaaaataacatcgtgacttttgaactagaaaaagggtcacgtggtatgaatgctgtgaaaataaaacttaagaaatagttcaatcctataatgccgtttttacggcattttttattttccattcaaaaaagatagtatctttgtaacgatggagaaatttgaagtacatatattaggatgcgggtcagcattgccgaccacacggcattttgcgacctcacaagtcgtaaatatccgtgaaaaactatttatgatagactgtggtgaaggagcacaaatgcaattacgcaaatcaaaactgaaattcacccggctaaaccatatattcatttcacatttgcatggcgatcattgtttcggactaatgggactgatatcaactttcggtatgctgggaaggacagccacactctatattcactgtcatgcagaattagaacgtcttcttactccgcaactcgactttttttgcaaaggtatgagttacaaagtcgttttccaaacttttgatccgggcaaagctgaaataatttatgacgaccgttcgctaaccatagaaacaattcccttacgtcatcggataccaacatgcggattcctcttttcagagaaacagactcccgcccatattcgtcgcgacatgattgacttttatgaaatccccgtatacgaactcaaccggataaagaatggcgccgattacacattaccggacggaaaaatagtaccaaacaacaaattgactatcccttctgcccttccccgccgatatgcctattgttcagatactatttatttgccacgtatcatagaacaaatatacggagtggacctgttatttcatgaagccacctttgcacaaagcgaacaagcccgtgcgaaagaaacctttcacacaactgcttcacaggctggagaaatcgcccgtaccgcaaaagtaaaacaacttcttataggacatttttcagcccgctacgaagatgaaagcatattgttacaggaagcatcggatatttttcctaacactctacttgcacgggaaacattaaaaatttcaatagaatccattaaaccataacataaaccggatatctaattaaaaaataggaacatgaacacttataatgagaaagaaataatagctttattacaggacccggcacgacaaaaagaagccttcgaatgtattgtcaacgaatacagcgaacagctatattggcagatacgccggatggtactttctcatgaagatgccaatgatctgttacagaatacatttatcaaagcatggactaatctagagtattttcgtgccgaagccaaaatgtcaacctggctttaccgcatagctttgaatgaatgcttaacctttttaaataaacaacgtgccaccaaccaattatccatagacgacgctgatgcagatatggtgaacaaactggaaagtgatacatattttaatggagatgaaactcaaatattatttcaaaaggcattactgacactccctgaaaagcagcgtatagtattcaatttaaaatactttcaagaaatgaaatatgaagacatgtctgaaatattaggaacaagtataggagcactgaaagcctcctaccaccatgcagtgaaaaaaatagagaactttttaaaagaatacctttaaacctttttaaaagaaatgtatctaacaaagaaaggagaaccactatgaaggaagaagatgaactattaaaaaaatgcgggacaaaaaatccattcatggtacccgaaggttatttcgacaacttctcaaaagagttgatgaataaattgccggagaaggaacaaacttctactccgcaagaaacaataactacttggcaacgtatcaagccttggatatatatggcagctatgttttgtggattgatgttcagcgtcagagttgttgtaggtccccctaaacaagatactcctatttttacagcagcggaaactgaacaattctcagacgaatatattgaaacgattttagatcattccatgatggatgattatacgctctatcaatacttgacagatgcaaattcagatatgtataattaaataataaccacatgatacaaagactggtaaccttgcttatcactttatatataagcatttcgctacaggcgcaagacaaaaagaaacctggtttcaccaaagaagaattcagagctagacaagaagcatatctcacgcaaaaagcagaaataacgcaagaagaggccactaaattcttccctatctacttcgaattacaagaccgtaaaaaaacagtaaatgataaagcatgggagcaagcacgcaaaggcaaaaatcctaaaacaaccgatgccgaatacgaacaaattatagaaggtattgtcaaagcaaggattgaagccgataaattggatttggaatatctacagcgctttaaaaaaatcttatctcccaagaaaatatataagttgcaacgtgcagagattaaattccaccgtgatatcttaaaaattatgcaccaatctcaaaaaaaataaaagcaacaagagatatttctaactttttccccaaatctatcaatcaacttagatttggggatttttgtatttaaaaagttcagcgaaacgacaaaatgcttaagatgcttcttttataaaaacaagttaattttcttgcttattaagtttttgttacattgattagaatatgcttttatttttaaacatttaccatcaaaaatattttgatttattagattttattactaggtttgtgcaaaccataaacttacaaatctattacaaacattatgaaaaagacactattactactattcgtatgcttattcgtaggaataagccatgcacaagcacaggtaacagtgaaaggaaccgttatctcaagcgaaaacaacgaaccggtaatcggagcttccgtattggtaaaaggaacaaccaatggaacaatcaccgacatcaatggtcagtttacacttacaaacatctcacctaccaacaaaacaattattgtttctttcattggaatggaaacccaagaagtaaccatcaagccggaaatgaaaattgttatgacttcaacaacagaagtgatggaagaagttttggtagttgcttatggtactgcaaaaaaatcagcttttacaggatctgcaaaaatgattcatacagaacaaataactaaacgtccggttactaatgtcatagaaagtttatctggacaagtggcaggcctacaaatgacaatgacaaatggacagcctggcgaaactccaagcattctgatacgtggcatcagttcaatgagcgcaaaaacagatcccctcatcgtattagacggtatgccatacgaaggaggatggaataacatcaatccagcagatgtagaatctatttctgtactaaaagatgcagcatccacagctctttatggtgctcgaggtgctaacggtgtcataattataacaacaaaatcagccaaagcaggcgatgcaaaaatcacagtagacgctaaatggagtgccaatacccgtggtgaaatagaatatgactacataaaagatccaggagaatattatcaagcacactataaagcattatacaattattatttaaatgcccaaggacaaacccctgaccaagcatatgtcagcgcaaatactaatatgataggaaccaacagccaaaccggcggtttatcctacaacgtatattcatatcctgaaggagaatatctgattggtaaaaacggtcttcttaatcctaatgcaaaattaggacggatagtaaacggttattatctcactcccgataattgggttgatgccacataccatacagctttacgccaggaatataatgtcaatatttccggtggaagtgacaaagcgcaaatctatgcttctttcggatatctagatgaagatggcatcgcacaaggttctgactataatcgtattaccggtcgtctgaaaacgacttaccaggctaaaccatggatgagatttggtgccaatatcagttatacacactcaatacagaatgcagcggccggcggctttgcccaggcattcaatacagcccctatatatccgctttacctacgtgatacaaatggtaagatcatgcaggataaaaatggtgacatgtacgatttcggagtatccaaccaaggtcctctaaaccgtcccatcaacccgaactctaacggaataaaattaagtcagcttgatacatataacacctctgcaaatactttgaatggagacgcatttatagatattaatttcctgaaagacttcaaattcacattcaatgcaggcacttcgatacgtgacagccggtacaaaaatgctttaaatcctttttatggaacagcaaattccttgaatggaagcatcaatgtccagcattggcgtcgaacaaccctcaacctacaacaaatattaaattataatcatagcttcggattacataacgtttcattgatggcaggtcatgaaagctttaataacgtttatgaagaattatacgcagccaaaaacagtatgttctctttttttcagaatcaagaattaaacggtgccatcagtggtaccaacgatgagtcatcctataagagcaaatacaatactgaaggatatttattccgaggtatgtacgactatgacggcaaatattttttccaactttcttaccggcgcgatgcctcttcccgcttccacccggataatcgctggggtaatttctactctgtgggaactgcttggattcttaccaaagaaaaatggttggatgacattaaatggctcgatttattaaaactaaagttttctgtaggtcaacagggtaacgacagaatagacgatttcttatatgtagatacttacaatatcaataacagcaataatgagttatcattaggtttttccagaaaaggaaataaaaatattacctgggaaaccaatacaaatataaatttaggtatagaattcgaactattaaaaggcagattaagtggtagcatagaatatttcaatcgcagaacaactgatatgcttaaccgtttttccgtacctttatcattagggtactcaggctattatgacaatattggcgacatgaataacaaaggtgttgaaattgatttaaaatatataccagtcaagactagaaacgtaacatggaatattggctttaatgcaacacattatagaaataagatcagccgtcttgcagaaagtaaaaaaacagacattatagatggacatgccggttatgtaaacggtctgtattattacggagaagaacttccaatgtatactaactatgttcaaaaatatgcaggtgtgtccgaagaaggcaaaccacaatggtattatacagataagcaaaccggtgagatgaaaacaacaacaacctattctcaagctgatctatacttatgtggtgacgctgttccagacctatacggtggtatcaatacctctctttcattttatggttttgatttctctgcacaaataaactacagtataggaggtcaggcatacgactatggttaccaagcattaatgtcacctcctacttcaactcatttaggatataatgttcacaaagatatttataaagcatggagcccggagaatactcaaagtgatattccacaatggcaattcaatgacctgtacagtgtaaaaacatccgacaggtttctaactaatgcatcttccataagtattcaaaacattcaattaggatatactttttcaaaaaaaacacttagaagtctatatctaactaatctgcgcatttatgtggcctgcgacaatgtttattattggtcaaaaagaaaaggtttcgattcacgcgtaacatggaatggaaataaagattcatccggagaatattcagccgtacgcgcattctccgccggtctaagtttacaattctaatcaacacataaacaatcaaaaatatgaaaaagaaatatattaccaaactaatgattgctgcatgtctgtcatcagcattaagcttaaacagttgtatcgaagaggtatttccagaaagtagcacagctaccatagaccaaataggaaaatctgaccaagctatcagcgcaatggtaaactcagtagtcgcatttattaatgcatttagaagttacggtccacaattttatcatgattttggatatagtggatataatttaatcagagaaagtgcatgcgaagacttcttctgccacgaacccaaatttgacttttttgatacttatggagtatgtaatgatttgggtgatgctgatgttgtcaataccatttggtattataactacaagtttctgaataatgtaaataatgcactgagtgctttagaaaaagcagatgatgcacccgaaaacaagtattataaaggtatatgcctatcttatagagccatgatatacatggacttagtccgaatgtatgaatataaaaaaacaggagtagagaaattagatgcagaagcagccagtaaaaatttatatggcataaccgtacccattattaccgatgaaaccacagaagaagaagggcgtaataatccacgtgctcccttctatgccgtatacaaattcatattagatgatctagcctcagctgaggagcttttgagtgattatcaacgcccaaccaaaaacttgccctgtaccccggttgtccatggtctgatggcacgtatgtggctggaaatgggatctcgtttcgaactttaccctgaagatctcaacaccctaaacaacaatacagatttaaacattgcatcaaaagaaacttgtttcactaaagcagccgaatacgcacgcaaagtcattaacgaaagcggagcaatgcctctgaccgaaaaggaatggtttggtggagacagctatactaccggcttcaacagtgtactaaccaattcatgggtatggggatccatcatgactaccgaggatgtacatagctattggctcaactttgccggaagcatgtgtcctgaacaaactttcggttacggtaaccgaaaatggcaaggatacaagcttatcggcaaaaaattgttcgatcaaataccaaatgcagactggcgaaaaacaacttggattgctcctgaagatgcacacaaagctcccggaactaaatataaaactttgttgaccgatgatgatttcgctgatatgcctccatatacaggtatcaaattccgacctaaaaatggagaaatgaacgattatacaatcggagctgccgttgactatccgttaatgcgtatagaggaaatgtatttaatcgaagccgaagcaataggaatgagccaaggattagcagccggtatttctaaattagaagatttcgtaaatacatttcgttataatacttctgtgggtagctatacatgtaaagtaaatgatctaaaagagtttcaaaagaaggttgttgaacagaaacgtattgaattctggggtgaagggatcatcttttgggattacaaacggttagagttacaagttgttcgtggttatccaggtactaatgctcctatcggatatcgatttaattcaatagaaggctactgtgcgccctggatgaatatctttatcagtctttatgaaaatgtattcaacaaaggtgcagttttaaatcctgatccttcacaagccatcaaagaatgggtagaataaaattcatgtaaaacttattttataaagaatggggagctgtcataaaaaaagacaacccctcattcttatagaacacaatttgatatcaccatacattaaattacctagaataaatacaataccctttattgattaaaacagaaaaacaagcaagacaaaaataacacacatcataaaaaacaattctaaccctactatttttcttcctttttagcctcattccatatagcatccatttcttccaaagtcatatccttcaagttctttccctgtttgatggtgtgttcctctaagtaattgaaacgacggataaacttctggttagtgagttccaatgcattatccggattaatcttgtaaaggcgggccgcgtttataagactgaacattacatcaccgaattccgcttccgccttctccttatccatgttctccacctcagcttcaaactcgccgatctcctcttttactttagtccaaacctgcgaacgctcctcccaatcaaatcccacgttgcgggccttgtcctgaatgcggtatgccttgattagcgaaggcaaagcaggaggtactccgctcaaaaccattttgttaccatccttttccttcatcttcaactgttcccagttttcagtcaccttctcggcagtctcggctttcacttcgccaaagacatgaggatgacggaaaatcagcttctcacaaagacagtcacacacatccttaatatcaaaatctcctgtttcactacctatctttgcataaaaggccacatgcaacaacacatcacccaactctttacagatatccttcttgtcatccttcatcaaagcatcacaaagttcgtaagtttcttcaatcgtattaggacgtagactttcattcgtctgtttccgatcccaaggacacttctctcgcaactcgtctaaaatatcgagaaagcggccaaatgcttccatttgttcttttcttgtatgcataatcagtttattaatatcattttgtagtgcaaaagtacataataatccaacgacttttattaattttgcactcaattatgcgataatcaattaaataaataaaatataaaatggaattagcaagtaagtacaatcccgctgacgtggaaggaaaatggtatcagtattggctggacaacaaactctttagttcaaaacccgacggacgtgaaccttacacagtcgtcattccaccacccaacgtaaccggagtactccatatgggacacatgctaaacaataccattcaggatatattagtacgccgtgcccgcatggaaggcaagaatgcctgctgggtgccgggaaccgaccatgcttccattgccacagaagccaaagtggtgaacaaactggccggacaaggtataaagaaaactgaccttagccgtgacgagttcctgaaacatgcctgggcatggacagaagaacatggaggtattatcctgaaacagctgcgtaaactaggtgcatcctgcgattgggaccgtacagcattcaccatggacgaagaacgtagcgaaagtgttatcaaagtattcgtagacctttacaacaaaggtttgatctatcgcggtgtacgcatggtaaactgggacccaaaagcactgacagctctcagtgatgaagaagttatttacaaggaagaacacagcaaactgtattatctccgttacaaagtagaagatgatgctgaaggacgctatgcggtagttgctaccactcgtcccgaaacaattatgggagatactgccatgtgtatcaatcccaatgacccgaaaaaccaatggctgaaaggcaaaaaggtaattgtaccactggtaaaccgtatcattccggttatcgaagacgactacgtagacattgaatttggtacaggatgtctgaaagtaacacctgcccatgatgtgaatgactatatgcttggcgaaaaatataacttgcccagcattgatatcttcaatgacaacggaacactgagcgaagctgccggactatatataggtatggaccgtcttgatgtacgtaaacagattgaacaagacttacaagctgccggattgctggaaaaggtagaagcttataccaataaggtaggtttctcggaacgtaccaatgtagccatcgaaccgaaactgtccatgcagtggttcttgaagatgcaacattttgcagacatggcattgcctcctgtaatgaatgatgaactgaaattctatcctaccaaatacaagaatacctacaaaaactggctggaaaatatcaaagactggtgtattagccgccaactttggtggggacatcgcattccagcatactttctgcccgaaggcggttatgtagtagccgaaacagcggaagaagctttgaagttggcacaagaaaaaaccggtaatgccaatctgaaaatggaagatttacgtcaagacgatgactgtctggacacttggttctcttcatggctgtggcccatttctttatttaacggtatcaataatcctaataatgaagaaataaactactattatcctactagcgacttggttacaggaccggatatcattttcttctgggtggcacgaatgattatggcaggatatgaatataaaggtgatatgccgttcaaaaacgtttatttcactggtatcgtacgcgacaaactgggacgtaagatgtcaaagtctttgggtaattcacccgacccgttggaactaattgacaagtatggtgccgatggcgtgcgaatgggtatgatgcttgccgctcccgcaggaaacgatattttatttgatgatgcgttatgtgaacaaggacgtaacttcaataacaaaatatggaatgcattccgcttggtgaaaggttgggaagttgccgatattgcacagcccgaatatgcaagactggccactgaatggtttgaatccatgttggcaaaaacagctgcagaagtagctgacttattcggcaaatatcgtttgagcgaagcactgatggctgtatacaaattattctgggacgaattctcaagctggtatctggaaatgatcaagccggcatacggacaacccattgacaaagcgacctatgaaaaaactttaggcttctttgataacttgctgaagttgctgcatccgttcatgcctttcattaccgaagagttatggcaacatatatatgaccgcaaagaaggagaaagcctgatggtccagcaattgaacattccgactgcttgtaatgagattatcgtcaaagaatttgaagtagtgaaagaagtaatcggtggtatccgcactattcgtttacagaaaaacattgtacagaaagaaactttggagttgcaagtagtaggtgtaaatccagtagctacattcaatcctgttattactaaattgtgtaacctctcttctatcgaagccgtagagaataaagctgacggctccggctcatttatgataggtacaactgaatatgccataccattgggcaatttaatcaacacagaagaagagttggcaaaactggaggctgatttaaaatatcaggaaggctttttgcaaagtgtattgaaaaaattaagcaatgaaaaatttgtcagcaaagcaccagccaacgttattgatatggaacgcaagaaacaggctgatgcagaaagcaaaatagcttctttaaaagaaagtattgctgctttgaaaaaataaaaaaatataccgctttacagagattgcaacattctatgtaaagcggtcatcacttcttttttagtaaagagatgtgtcaaaagtaattctgctattgtcttgctgcaaagctcggatagttttgataattacttcaaattttgacacatctctttcttttttctaattgtctttcattattcaacgggtatgatctttcctgtttttctgagaaattttcaattctactataaaagcaactaccaagcccaaaccaccaaaaagcaagacatttgcaccataaatcaacgaagttaactcgctcatgcgccaattacgctctgtgaaataatcgggaaccgtggttgcacaaataatataaccagtcaacaaccctagtcccatacccagcaacaaacagccaaatttcaaggccgagaaagaaatcggagaagatgacatgaaaggagttcctacaggaagaggcaggctaagcctgttccccaacatggaaggatctaacttgtctcccaatttttctatcatagtaagacgctctttcttaccaacaaaaagttcaaataatttgtagattcctaatgtaatgatacctacaacaatccaaccggtaatgtaacccataatttattcgtatttaagttattaattttgttcctttgtatccattagacgctgcgtagccaaagaggttacacttttgagaaagaaaaaaatattttctctttttatgtaacctctctcccagccctgcgtctaatagacaaaatggaaaacgacgaaacacatattattcataggatattaaaaggagaaacttctctctacgaatacttcttgggtaaatacagtcagcaagtatttatcctgattatacgcatcgtggagaatcaggaggatgcggaagagttgacccaggatacgttcttgaaagcctttgaacatctttcgtcgtttaaagcagagagtagtttctctacatggatataccgcattgcatataacaccgccatatcggcaaccagaaaaagaaaacaagagttaattgttatggacagtgccatgttaatgaatatatctgaccagcaaatagacgatgccctgaatgatgaaagcggggaacgggtaggaaaactcaataaggccatcaagaaactggatgcagaagaacgcaccttgatttccctattttataatgaagagaaaactatcggtgaaatcgcccttatcctgggactgacggaaagcaatgcaaaagtaaaattgcatcgaataagaaaaaaattatatatactcataacagaagcagaatgaacgagaaacaaaaagataaaggattaatgaaggctgtaaaagaacagccccaattccggctgacctccaattttactttccgcaccatgcagaaagtagaggaagctatactcttacgtgaaaagaaacaggagagaaagatgttactagctactattgctgcttctctattcttaataataagcagcagcatcggtctgtatatttattttggaaagcatcttaaagcaactatgtatcatgcatttagtcatgttttaaaaacacaaatacctctcatttatctgctattcatcataactatacccttattcattatttttgaccgatggatgagaaaacaatattttaaacaccactcttgaaaaatcattttcctctcctatgatataaaaaagcatcgggaactttactatcccgatacttctattattttatctatttttcaagcaagtcttttaaaaatgcatccaattcttcatccaaaccctttaaaagttcatcattcagtaataaagtgtcttcctcatctatcaataaaagttcggttacagtttccctatcctcatcaactaaaacaaaagaataaggcttcattatagctaacttatccaaaactcccgtatctttcaatgcgttgatctccccacgaagtatacgctctactattgtataaaaatcatcttcactataatccacccactcttcaattatggtacgtgacaattcttcgtcatcatcattaaaaataactaattcaccactgtcctgcttaggttgcaaatggatatcggtgactactgttctctctccatccgctatatatttatcaaccgcttcccggagcgaagacgcaatagaagcatgtgactgtgcactgaatttcataccaaaatcaattttatatattatttatatccaaaagtacaaaaaaaatctttctctcaacacttattctctaaaaattatcatcaaaacgtttcatttgtattcttaattgggatagcttactctctcttttctctaactccaatgaataaaaggctatcaattgttcatccctgctgcctgatttcaccaatttcttcgctttacccaaccattccttggcctgttctacattatcctttatttcataatatagtgcaatattaaaagccgctttcatcttttgctggccttttctcttctcataggctatcttccactgactatacgcttcatcccaattgttctcacgaagatatacaccggcatcacgcatttcaatattcccgccatcgtaataaaaacgagccacctcatcccaatgtggcaacagatgttctactggaatagaagcggcatattccgaagcttcttttactatcttccggtcagaaagagctggttctatttcccaggaaatggtatcttgcttggcaactacaaacaaaggtttatcacgattgggaatgtatactctaacaatcggagatataattccatctacagcatctataggcataggaaaatccggatagaacagtacgccgggcttagtctgaatatgaatacgatcaaaagacaatatcatatccacccccaaatcctcgctcagtttccgtacttcctcattggtcagaatgacattaacccgtggcactttatcctgtgcccggaatacagaatcacagataatgacctgatcgaaataattcacattggcaatattctctgccaaagcttcggatgccactttaccatcgccttccaattcgctgctcagtatttcatgattatctttagttttcagtacaggcatattgtttatcacagccacttttctcacagcatctggaaaactgacatcggctgcctgtaactgatcaaaagatatggtctgcaaactgctgcaggaagcaagaagcgtcccagcaactagaattattaatgaaacggatcttttcatattatcattttttcttagggaacaaaaatacgcttatttacgtaagaagtgagttaaaaggaataaaaaaaacgtccgggtagtaaattcgccccggacgtttctataataatcgttatttatcacgcattttgcccgtgacagttcttgtatttcttaccgcttccgcaaggacaaggatcgttacgacctactgtcttctctgcacgaaccggctcacgctttacctcacgagtatcacgttcggcagcagcttgctggtgaggatcacttaaatcctgcttctcctctctatactgttggcgaggagtctgcggttcgggagcagcctcacgaacttgttccggttcttgaaccgggatttgtccgcgcatcaatacagagatggtattattattgatcttatgtaccatgttgtcaaacaaattgaccgattccaacttaaagatcagcaacgggtctttctgctcatagctagcattctgtacagaatgtttcagttcatccagctcacgcagattttctttccaagcatcatcaatagtatgaagcagtatcgccttctcaaatgatttcacaatctctttaccttctgtttcataagccgctttcaagttaacagaaatattatacaagcgcttgccatcagtaataggaatcatgatgttttcatacatatgtccttgcatctcatatacctgtttgataacgggattggcaatctgggccatacggtctgtcttgcgcttgaagttgttcattgccgcttcaaaggttttctctgcaagatcttcttttctcatcttgttgtactcctcttctgtgaatggtacttccattgccaatgtctgcaatatttccatcttcacattatcaaagtcgcccaattctacagcatatgcgcaacgatcccaaatcatattcacgatatccataccgatacgctcacccatcaaggcatgacgacgtttggtataaacagccacacgctgtttgttcatcacatcatcatattccagcaagcgtttacgaataccgaagttattttcttccactttcttctgcgcacgttcaatggaatttgaaatcatcttgtgttcaatcatctcaccttctttgaagccaagtttatccattacactggcaatacgatctgaagagaacaaacgcatcaaatcatcttccaatgatacaaagaacacagatgaacccgggtccccttggcgaccggcacgaccacgcaactgacggtccacgcggcgactttcatgacgttccgtaccgataatagccaaaccacccgcagctttcacttccggactcagcttaatgtcggtaccacgacctgccatgttagtagcaatagtcacgatactcttctgacctgcctgtgccacaatatccgcctctctttgatgcagtttcgcattcaacacattatgctcaatcttgcgcatagcaagcattttgctcaacatttcagagatttccaccgaagtggtacctaccagaacaggacgtccttcttttaccatttcttcaatctcttcgataacagctttatacttctcacgttttgtcttataaacgcgatcattcatatctttacgggcaataggacgattcgtcggaataacaacgacatccaatttataaatatcccaaagttctcccgcttccgtttccgctgtaccggtcatacccgacaatttatgatacatacggaaatagttctgtaaagtgatggtagcaaaagtctgggtagcagcttccaccttcacgccttctttggcctcaatagcctgatgtaaaccgtcagaataacgacggccttccataatacgtcctgtctgttcgtcaacaatcttaacctgtccgtcgattacaacatattcgtcatccttttcgaacatagcataagccttcagcaactggttgatagtgtgtacgcgttcagacttgatagcgtaatttgtcatcagttcatctttcttggccagcttttcttcttctgtcagatctgtctcattttccaaagcagacaattgggaagtaatatcaggcaaaacgaataaagtaggatctgccgcatttcctgtaatcaggtcgatacctttatcggtcaaatctacgctgttttgcttttcatcaattacgaaatacaatggatcagtggcttcaggcatacgcttgttattctgttccatataaatttcctcggtcttcagcatacctgccttaataccttgttcacttaggaacttgattaatggcttatttttggggagtgccttatgactacggaacaatgccaaaaatccctcttcctgatctttcttgtcatccgatgcaatcaagcgtttggcatcggccaaatattgggtagccaactttttctgagcttcaaacagacgctctactaaaggacgaagttgttcaaacaactgatcctcacctttaggaacaggaccggaaataatcaacggagtacgagcatcgtcaatcaatacagagtccacctcatcgacaatagcataattatgtttacgctgcaccaagtcttttggactgacagccatattgtcacgcaagtaatcgaaaccgaattcattattcgtgccgaaagtgatatcggccatataagctctgcggcgcgcatctgaattaggctggtgtttatcaatacagtccacactcaatccatggaactgatacaatggccccatccattccgagtcacgttttgacaagtaatcattaacagtaactacgtgtacaccattaccggtcagtgcattcaaaaatacaggtaaagtggccactaacgtcttaccttcaccagtagccatttcggcaatcttgcctttatgtaacactacgccaccgaataactgtacatcgtaatgcaccatgctccataccatgtcattgccaccagcaatccaatggttctgccaaatagctttatcgtcctcaatacgcacaaaatcttttccttgagcagccaattcacggtcaaaatcggtagcggttacaatcaattccggattttcagagaaacggcgtgcagtgtcttttacaatggcaaaagcctgcggaagtacatcatctagtgccttttcatatttttccagcacttctttttccagtttgtctatctgcgcgaagatgccctcacgatcttccagttctgtagtttcgatagtacctttcaattcttctatcttcttttgttcctctgcagccgaatcagaaatgtatttctttaattctactgtttttgcacgaagctcgtcattgctcaatttggcaatttccggataaacagcctttactttatcaacccatggcttgatttctttcatgtcacgagtggccttatttccaaataatttgccaataaattcattaaatcccattgtatttttttgtttttattattttctaatttgattacttttgaaaatgcaaagttacaataaaatgcagattaatttgcacttctttccttaatattattttctgatgtctgtcattggtgccagaacggctgcattaggagcacgaatacgcatataatgagctacggtgggtgctatattacctatttttacaggcgcatggattatttccggttttattccgttcccaatgaaaatcaatggagccgacgcatacgaatagcgttgcacctgcgtatcaagcgaatgttcacgaaacacagtccaacctggtaaaacttctatccacaagtctccagaacatatcgggttatagtaattctttattttatcaatggtaggagtccacgcccccaattgtaaacgttgtgaagaatatacatctttcaccccactgaactgtaccaaaaattctgccgcacggttcaacatctcggacatattcagttgtttctgctctatcagcttatgattcaaatatatttgttgctcaaaatgtgcctccacccattgcccttcaccgtaaatagcagccaaataaaggtttaacagagcagaacaacgttcaatatggaattctccacccggtattttatattgaggaggatcaacaggatctgtgtcagcatatcctgtagaggttataaagaataaagtattgttcaaaccaactttccggtctatcaattccaataattcagcaatactgttatccaagcgtacatatgtatcctgcatttccatcgggagttctgcaggagccttatgatcataattcccggcataatatgctagtgacaaaaagtccggaacagcatcctttccaatggaagtattactcaaacaagcattaaccaaacggtttacctcatcattagcatagggacttgttttcaatttacggtatttatttttccgttcatcatcgaaattatgcttgaacgtaacttgtttgttctcgctagtcaaatatttatagacagtcacaggcaaataaggcgcccacgacatattgccgatacggaaatctagtccttcacggtcattataagtagtcacccatacaggaaatataccgtaatatgtgctgccactccattttcctgtttcatcattcaaccagaatgcacctttcgaagcatggccggcagctaacaccgccatttcacgtgtaggagcgatagaataaacttcagctactccttgtgtggctattatcaactcatctgtcaaagtcgacaccttcattttctgcggagaagtagactctgaagtataaatgcccataaaatcagcatcgtccacacaattaaggactcgaagagtactgcggtccatccagttatcccccacgattccgttggtataaggtgtagtaccagaataaatggccgccacagctgatgacttatctacattaataaaatcatattcggcattccgataaatccgtccttctttccacaaccgcttaaagccacgttcaccgtataaagccgaaaaagcctctatataatcagtccgcaattggtcaatagtcaatccgaccactaacctagggaccgcaggaatgttctgtgcctgcaaccctgttaatgcgataacagtcaaaagagaagttaagatgcgtcctttcatttattgttttgtctgtaatataataaaacgtggtttgcagaacatattaacaaacacagtgccaaaggtaataccgttacgttgaatttttgctgtataaacggcattatcatcataaaagatgttaagcacactatatttattgtatgatagtagtcttttttaccttttatagctcgataaaccataaccggaagataaattaaagggataggattcaataaaaggataagccaattggaccctaccgtaggatgagtagaaaaaaagaccaagaaagtgatgacacatcccgccaatccttgtacaccgaaaagaagcaaatcccaaatccagattattttcctgattttaaactgcaaccaccctacaaagcaagtaactcctattaaaataaagacacacaccatgggtgacaacggaaagccttccctaacatcctctggttctacatccactacctttttttcatgcagaatcaaaggacgcacgctgtcacctactactatagttgctttttttgctgcctccaacatataaaaaggagcgaacatctgcttacgcgtatcaataggcttatcagcttcactgcccaaacacatatcaatgcccagctcatcccattcgtgccctttagtatattgatggacaatatcccgaaaagagagtctctcttttccttcagaataaacaacctttccttcaatacacttttctattatatcacgcgcacgtgtagtgcaattatcatagaaaaagttataacgataaaccctattcttcggcagataattctcttccagcaatcttctgagtttctgtttttccgaaatagtcaaattcaatgtctgctgatagaccgaggaaccacgcatagcataactaccttcaaaataaggataacgggttacgcccaattcataatcagtctctcctttgacaaaacgatagataaaacggggagtattaaagctgaacataccataattaaacacccagtcctctccacgtgccgtatcctcatagcgcaatgccgtatgcccgaacaaagcatatatttctgtaccgggagcacaagtcatcagactcacctttatattatcctcctgacctctaatcgattgactcaaggaaaagaataacaaaatcaatgctataattaatttattcataaaatccattttctgtttaccgatgcaaaagtacacctaaatattaattaattcctcacaaataccattttttattgctattcctatttattttttacgttactttgcagccgaaaaagcaaagttgtgaatttaataatcgacataggaaactcagtagctaaattggctatatttgacaaaggcgagttagttgaagtatttcgtggctccaatcattctttagattgtctcccgatgctttgttctcgataccccttgaaacgaggtatcatagcttctgtcataacactaagcaatactatccggcgccaactgggaagattgccttttaatatcatcgaattaagtcatgaaacccctgttcctatcactaatttatataaaacgcctcaaacactgggtatggaccgtttagcagctgtggttgcagcaaactggctgaagcctggacacgatgtactggttattgacgcagggacctgtgttacatacgattttatcgatgccgacggatcctatcatgggggcaatatttctccaggaatgcgtatgcgtttcaaagcattgaacatattcaccgacaaactccccaaagtaagcgccaaaggagaagttccgatgtatggacaatctacagaaacagctatccgggcaggggtcattcgcggaatggaatttgaaatgagcgggtatatcacccatcttcaaaagaattatccgggacttttggtttttttaacgggcggagatgaattttcttttgatacaaaattaaaaagtatcatctttgcagatagatttttagtattgaaaggtttaaacagaatattaagctataatgataaactataaaagactgattagtgcgtcaatattactcacagtcacagggctagccgtagcccaaacaagcacaaattctccctatacacgctacggctttggtcagttagctgatcaaaattttggtaacagtaaagcgatgggaggaatagcatacggcttgcgaaacggctaccaaatcaacgcatctaatccggcatcttatacagccatcgattcattgacattcttgttcgatgcaggaatgacccttcaaaatgcgaacttcaaggatggtaatgtaaaaaccaatgctaaaaattcaagctttgattatttggctatgcaatttcgcctatggaaaaaaatggggatgacagttgggtttcttccattttccacagtaggttacagcatctccaaaacacatgattttgaggatgttaacaataacgggaagtggagcgaatcttatgatggcgacggaggttttcatcaagttttcataggattaggttataaagtttttaataatttgtctgttggtgcaaatttttcgtatctttatggagatattactcatcaatccatgacaactattggagcgacagatacacgtagtattaaattagacaaattttctatcagtgattataaattagattttggtttacagtatacttataagttaaataaaaaaaacactattaatataggtgctgtttataccttgggacgtaccttgcatggagatgcatataagtatcatcaaacaggtgcggaaagtaatggttctatctatgtacagtcacaaactggcgatactattccgaatccgtttaaaatgccacatacatttggtatagggcttacatatgtatatgataaccgcttaactataggggttgactatactttacaaaagtggaatacagccgatctagcttggagtaagttcaataaagaaagtgtggaaatgaatagccgtacaaaaatagcttttggtgcggaattcgtaccaagttatatcagccacaactatctgaaacgtattcgttaccgcatgggggcctattattcaagtccttataataaggtcagctatactagtccggacacaggaacaaccagtttccaagacggtgcacgcgaatatggtgtcagtattgggtttggacttcccatgttccaaagtaaatctatgctgaacatttccgggcaatacattaaagtcagtcctaaatttaaaggattaatggaagaaaattatttgagaatcaatattggacttactttcaatgaacgttggttcatgaagtggaaagttgattaataaaatggagagaagcaaataaataacaacaactaaatttatatacgatgaaaatgaagatggtaacagcgctgttcgttctttccttaggtacgacagcttctttcgctcagaccggagcgtcagacggatcaagattcggacatggtgaagacagtatccgatgcttgaaaaatatcagtatttacactgagtatgttaagactaacaatttcaaggatgcttacactccttggatgagtgtatttacagaagcccccaaagctcaagtaagcacttatactaatggtgcaaaaattcttcgtgccttaatagccggtgaaaaagatgcagctaaacaaaaacaatactttaacgaactgatgaaagttcacgaccaacgtatccaatatctggacgatttgaacaagttggttaaaagagatgctacaaaaggctcaatcatcggtatgaaggcccatgactacttcacaatgggtggccaagacatgaatgaagcatataacatgttcaaagaagccattgaacttgaaaaagaaaactctgactactttgtattacaagagttcatggatgcagctgcccgtaaaatgaaaagtgatgaatcatacaaagaacaattcattcaagattatttatttgcatcaggagttgctgatggagctttgaaagccgctacaaaggaaaatgacaaaaaattattgaaagtggcaaaagacaatattgacgcattcttcattaatagtggtgtggcaacttgtgataatttacaagcaatttatgctccgaaagttgagcaaaacaagactaatttggattatctgaaacaggttatctctgtaatgcagatgttaaactgtacagaacaagaagcttactttgctgcatctgaagctgcacatgccatcgaaccgacagcagaaacggctgtaggttgcggatacatgtattataagaaaggcgatatggacaaatgtatcgactattttgatcaagctatcaatttagaacaagaccaattaaagaaagctgattatgcatataaaaccgctgccattttatttagtaagaaacagttgagcaaagcaaaacaatatgcactgaaagcgatctcgttagatggcaacaacggtaaaccttacattttgattgctaacatgtatgcatcaagtcctaattggagtgatgaagcagcattgaacaaatgcacttattttgcagttatcgacaaattgcaaaaagcaaaaagcgtagatcctagtgttgctgaagaagcaaacaaactaattagtacttatgcagcccatacccccaaagatgctgatttgttcttcctcagtttaaagaaaggtgactctgttacaatcggcggatggattggtgaaacaacaactatcagataattatgtcgtctgaaaaagaacaaaaatcacactttatattcttaaacataacagttgccgtttggacaactgttatgtttgttttatttccagcatgctcaagaggcgaaaagaatctagcagaagctattacagaaagagattcgttgcccagcatgaaaacattgggagttactacccttatatccgattccggtatcacccgctacaaaattatcacagaagaatgggaaatttatgataaaaagaatcctccttattgggcatttgaaaaaggagtttatttggaaaaatttgattccctattccatattgatgccagcataaaagccgatacagcttattactacgagaaaaagaaactttgggaattgagaagcaatgtgcatatccgcagccaaagaggcgacaaatttgacacagatctgctcttttgggatgaaaagcaggaaagggtctattctgacaaatttatccgcattgaacaagaagataaaatcattaccggttatggatttgaatctaaccagcaaatgacagaatatcaaatttataataacacaggtattttcactgtagaagatacagcaccagcagacagtacaaaagctgttgcaaatagcactagaactgattcgatacgctaattcactcactattatgggtattattatacagattcttattacaatggctttttccgcttttttttccggaatggaaatagcctttgtttcatccaataaattacgttttgaaatggatcgtaacaaccaaagcataaattcacgtatactttccatcttctttcataatccgaacaattttatctctaccatgttggtaggaaacaacatcgctttagttatttacggtatattgatggcacaagtcattgaacaaaacttgttgtcaggattgatagacaaccactttttattagtactaatccaaacaattatttccacattaatcattttggtcacaggagaattcctacctaaaaccttatttaagattaaccccaatttcactctgaatatttttgcagttcccacttacatttgctatgtcttactctatcccatcagcaagtttgcttcgggaatatccaatatattactttacattgtaggcattaaaacaaataaagaagctaatgaaaaagcttttactaaagtcgacctagattactttattcaaagtagtatacaagatgctcaaaatgaacaagacatagacaccgaagtcaagatattccaaaatgcactagatttttcgaatattagaattaaggattgtatggtacccagaaccgaaattgttgctatcgaatatggaactcccatagaagaattaaaagcccgcttcattgaaagcggaataagtaaaattattgtctataaagaaaacattgacaatattataggttatatacattcctctgaaatgtttcgtgaacagacagactggactaagagtgtccgccaattgcctattgctcctgaaacgatgggagcgcataagctgatgaaattatttatgcaacaaaagaaatccttagctgtagtagtcgatgaattcggaggtacatccggcatcgtggcgctagaagatttagtggaggaaattttcggcgaaatagaagatgagcatgatacaacttcttacattgccaaatccgtcggtgacaatgaatacatcctttccggacgtctggaaatagaaaaagccaatgaattgttctcacttgacctaccggaaaatgatgattaccaaactatcggtggactcatcctgcaccaataccaaagtttccccaaaatacatgaagagatcattttcgataaattccatttcaaaataattaaagtaacagcaacaagaattgaattagtaaagttgaaagtaatcgaataacagatttttttcacaataaaatagcttgtaagctgcattttttgtatcttcgtgcgctaaatctatgaagtataaaaaaacaataaacaaaaatagtaaaattaaatggcaacattacaaacaatcagaagtaaaggccctctgttggtcgttgtaatcggacttgccctcttcgcattcattgccggagacgcatggaaggttctccaaccacatcagggtaaacaagacgtaggtgaagtaaatggaaaaacacttacagcacaagagtatcaaaaaatggtagatgaatacacagaagtcataaaattgacacaaggtgtttctgcattaaatgacgaccaactgactcaagtgaaagaccaagtatggcaatcttacgtaaataaccaattaatcgcagcggaagctgcaaaattggggttgaccgtcagcaaagctgaagttcaagcaatcatcgaggaaggtactaacccattgttgatgcaaaccccgttccgcaatccgcaaaccggtgctttcgacaaagatatgttgaaaaaattcctagtggattacgctcatctggacgcaagcaaaatgcctgcacaatatgtagaatactatcaaaagatgggagctttttggaattttattgaaaagactttgatacaatccactttagctgaaaaatatcagaacctgattgcaaaatcattgatttcaaatccggttgcagctgaagatgcttttatatcacgtactgaacaatcagacgttttattagctgcaattccctattcttctatcagcgattcaactattacagtttcaaatagtgaaatcaaagatctgtataacaagaaaaaaggttcttttgaacagccagttgaaactcgtaacatcaaatatattgatgtattggttactccatctgacgaagatcgcaaagaggtattaaacgaagtaaccgaatacgctacccagctaggtactgctgcagacatgaacacattcatccgttccaccggttctgtagttcctttttctgaaattgcaatcaacaagactgtatatcctaatgatgtagttgctcgtttggactctgtaactatcaacgaagtatatggtccttactataaccaagcagatgattcatataatgcttttaaaattattgccaaacagacagctcccgactcaatccaatatcgtcaaattcaggtatatgccgaagatgctgctaaaaccgcaactttagccgatagtatttttaatgcactgaaaggtggagcagactttactgatattgcaaaaaaatatggtcagacaggtgaagcgacttggttgactgcacgcaactatgaaggtgctgcattagatgcagacaatgctaaatacattaacacattgataaactctaatgtcaaagaattaaccaatcttcagatcggacaagctaacgttattcttcaagtattggacaaaaaagctatgaaagataaatataaagttgcagtgattaaacgtccggttgaatttagcaaagaaacatacaacaaagcatacaatgatttcagtcaattcgtagcacagaacactacaatggataaaattattgccaatgcagaagaaagcggatatcgcttgttagaacgtgctgatttccgtagcgcagaacaccgtgtgggtggtgtaaaaggaactcgtgaagcgttgaaatggatttttgcagccaaggaaggtgaagtgtccccattgtatgaatgtggtgaaaacgatcacttgatggtagttgctcttgaaaagattaatcctgccggatatcgtaatattaatcttgttgccgacatgctgaaagcagaaatcatcaaagataaaaaagctgaaaaactgatagctgaaatgaaaagtgcaagcagcattgaccaagtaaaaagtatggcaaatgcagttagcgattctgtaaaacatataactttttctgctccggcatatgtttcagtaactcgcgctagcgaaccagctttaggtgcttatgcaagtaaagctgaaataaataagttaactggtcctatcaaaggtaatgcaggtgtttacatgattcaggtttacaacaaagaaaagagtgcagaagaatttgatgccaagaatgaagaaaacaacttgtccaatatggcagggcgttatgctagcagtttcatcaatgacctgtataagaaagctgatgtaaaagacgaccgttacttatatttctaatatcagaaagttatcaataagacaaaacaggctgtatcgaaaattcgtcgatacagcctgttttgtcttattcctattttcgcaaaaattaaagatgaaataatttataaaatctattcgtttacgttccgtattcccatttttatcattatgtttgcaacagtaattatgaagtattttattgctatatgtacgtgtatccttttgttatgtagctttaatagtacaaataaaggaggaattatccgcgaatgcccgccagaagtcatatcttctatatccatgctttcggatgatacgaattcctatcgccaattatctacagaaaaacgatatgacgctcctaatgtgaaactatccgaagtaaatcttttatgtttcactttacgtactccgatgtttaccaaaacatcaaaacccttatctacaatcaaagtactttgccattaccgtattcttctacctgaacaaaaatttaatagcctatatcctagcattaattatgtaaaatcctcgtgtaaatacttcatttacacattaggacatattttgatttagcagctatttcctcttacttattcttgatcattatcattccggattgaaattattctatcggcgtgtatacatatatgtgtgacactacgatgtgaatatcactataactcggaatttaatactattttacctactaaatcacatttatattataatgctacacttatttttatccacattgaccatgatggggcttactttcctcatcggtttttttgtcgctgctattattaaaggaatagcgctggcagcagattctatggatttctatagctcccacctattggaacttcaacgtttaagaaaaatcaaaaaagcacgtgcccgttttatccaattagtatggaataattctccagaagagatggaagctctaggagacagccgtgaaaactggaaccgaggaatgaacagcgatctgagaggaaaacaggaaggtggttactaccatggtgtcagtcatggagcatcccaattaaatctgatagattattactatccggacacaaagatgatctaccttaagaaacgggaggaaatgcataatcagcaacaaaaaagcactcatgtgaaaaagaatctttcaatgaataaataacctgaaaatcaacaattagatatggaaaatatagattttggaatacttttccaaggcattggtacaatgatagaaagcggttggttccttgcctgtgcgcgcgtttttttaattcttttgggatttctactcatttatctaggttggaaaggaatattggaacccatggtcatgattccaatgggactcggtatgatagccatcaattgtggaacattaatcatgccggatggaaatctaggcaatctttttcttgatcccatgctctcggatacagacgaattgatgaataccatgcaaatagattttctgcaaccggtttacaccctcacattcagtaatggactcatcgcttgtttcgtcttcatgggaatcggaaccttgctagatgtaggtttcctgctacaaaaaccttttgctagtttgtttctggcactttgcggagaactaggaacctttctcacattgccaattgccaatgcacttggcttatcggcacaagagagtgcttctgtagccatggtaggaggtgcagatggtccgatggtactgttcacttcattggcattagccaagcatttgtttgtaccgattactgtggtagcttatctctatttaggattgacttacggcggttatccctatttggttaaattactgattcccaaacgtttccgttccatcaaaatgaccgtaaagaaagcgccgaagaattacgatgccaaggtaaagcttgctttcgcagcggtactctgcgctgtactctgcttcctttttccagtggcctctcccctgtttttctctctatttctaggagtggctgtacgtgaatcagggatgaaacatatttatgattttgtcagcggtccattgctttacggttctacttttatgctgggattattattaggagtgctttgcgacgctcatctgctactagatcctaaaatcttaaaattgctgatactaggtatgttggcattgttactatcaggtatcggaggtattttaggcggatatatcatgtactatatcaagaaaggaaattataatccagtcattggcattgctgctgtaagctgcgtaccaactactgccaaagtggcacaaaagattgtcagtaaagacaatcctgattcatttatcctaggagatgcactaggagccaatatatcgggagttattacttcagcaattattacaggtatttatatcacaatcatcccgctattatgaaacagcatgaatcctacctaataaatttcatccacttttaataatgctatcattttcgcagagggcagtccgcgtatctgccctctgccaccactaccaactaaaaataattggaatggtgaattgattcacataaaactcccgataccatttctttgaattgaaataataccccgtactccatctttcattcactaattgaagtacccgcaatgcttcggcatccattaatggatcaagtcctctcaccaactgaaaatctttcattgaaccatctatatccacattgaaactataaatcacccgtccctgctttcccgtagccttcatttcgggagtaattttcagatgagaattaataaattgcgtcaaagcaacagtaccaccgggataagaagagtatctataaggctcccaagtgatcttttccaaatcttcctgtgcgcattccctatataataaataatgctccagatcctctttccaaaaacgcatagttaaaaaataatcatatggcacagattttctgtttttcatagcaggaatcaaccggggaaaattagaaagaatacgtatggactctttatcaaaagccggatgagtaccttttatcacacggatatccacaatttctcctttttcatttaccgtaaaacggcaaatagcgacggctttatccactttatcgtcaggccaactcatatttcccataacaagactacgaatatcatcaggaaagacaggcatggaatcgacaagttgtcctctgcaagattccagaacttgctgctgccgccaaatgcggtcactgtaaacatcaggattaaaaggaatatgaaagacgatagtagtatctatatctctacccgctttctttgcaggctgccattcacgcataccctcaatcacatcttcggccgccttagcaaacaaggggtgagtggcttcaatatatttacaacggacagtccccaaactatcaatgcggagcgtacacacagcttcacctgcaatattggcccttaataaagaatccggatatacgagctgccacacagcataatccgtaataccttttactgtaggataatatggcgggagattcatgttcttttgtgcataaaaagatagaaagggaaatatgcaccctattaataaaagtgataatctattattcatgcctaagtcaagttttcacaaaattagcgactacacatgatataaacaacaccactaacattaatatatataaaagaaagcggagatacctcatcgcatccccgctttctacattaaatactaactattaattattttcaggacgaagtttacgtacggttacagcagtctgccacatttcgctttcacgcaatgccttcaattcttcttccaatttttcacgataatcgggtttagagttagaatcgatagaaatctgagcctcgttgccagtcttcacactgtgatataacttttcaactacgggtttgatagcatcgtgaaatggggtcatccaatccaatgcaccgcgctgagcagtggtagagcagttagcatacatccagtccataccattcttagcaaacaaaggcatcaatgactgggttaattcttctacagtttcattaaatgcttcagaaggactatgtccgttttcacgcaatacttcatactgagccaacaacaatccttggatagcccccattaaagaaccgcgttcacctgtcaggtcagaagttgcttcacgctggaaagtcgtttcgaataaatagcctgaaccgataccaatacccaatgcaatagtacgttcataagccttaccggttacatcctgatagatagcgtatgaagagttcaagccacgaccttccaagaacatggtacgcagtgaagtacccgaacctttaggagctaccatgatcacatcaatatcagtaggaggaactacccctgtacggtcactccaagtaatggcaaagccatgagagaaataaagtgccttgccttgggtcaagtaaggtttgatagtcggccatacagacataacagctgcatcagataacagacacattacgatagtcgctttctgacaagcctcttcaataccaaacagagtttcacccggaacccatccgtcagcaactgctttttcatatgtttttcccggacgctgaccaacaattacattgaaaccattgtcccggagattcaaagactgccccggtccctgtacaccatacccgatcacagcgattgtttcatctttcaatacttcacgtgctttttccaaaggaaattcatcgcggataactacagtttctgtaacgccgccaaaattcaattgtgccattttaaattataaattaaaaattaaaaattagattctaaataaatatcaccttactacgaacgacaacatctgtgccattcttcttcacctctatatcatattctttctcctccacttcctcgcggtagaaactcaatatatcaccataataactctcagctacataagccatctcaaaacgtttaatccgtttctctttaaaaaactctataggaaacaaatcgagaatatgttctatatacttaatactgttcacatgaccattaatatcaatatcgctatatctggtctggtattcagaaaccggagctttctctgtcaccttaatacgaccgggcttgcttataggacatttcttatcgcatacataatcaatgatactacctccgtgaagcgtaagcaggtcagcaggtttgcgagtttccatactgatcatcgcccatacagaacgggcgtatccgacagtctttccttccttgtccaaaattgcaaaattacggtctgtaaaaagacgataaacattctctacccatgtctgaatactgaaaccctcatattgacagggcatattctctaactctacagctaaacgggaaagtacccatgtataatgattctcattgagcgtagcaattccgaaaccccggtcggcagcatgaaagccggcacaattcagtaaatgattacccaacacactcatggtcaactttccactgaaatcacagtgaaagggttctgccacaaatctgtatgttcctactttattctcactcatcattattctgttttttgctggcgatacttttcctcgcgttgggtcagatattcgttcacacgctcgaaacagctggtagtaatggccacacgtcccgaacggacaaactgcaacacacatcccaatccgcgcaactcctcataaagagcagtaatttcctcactcatcccattcttttcaacaatagagaaaaccggattcacttctacaatgcgggcactataacggcggataactttagatgccataggattctcctgaaattcaggagtagaaaccttgtacaaagcaatctcatgctgataaatctcactatcagtaaaataatgtgcctgcaaaacatctattttcttttcaatctgcttcaccactttttctatcacatcctgggtggtccaagcagtaatagtatatttatgcacccccttgatggaagatgcagaaacattaagactttcgatattaatttggcggcgagtaaacactgccgtaatctggttcagcaaaccggcgatattttctgaatgaacgattaatgtatataatgtcttgtccataattattaaattagcattccagtaacatctgattcaccgagcctcccggaggtgtcatcggcaacacatttccctcttctatcacacaagcttccagcaggaatggcccgtcagtagtcaacatttcatggatagcagcctgcaattcctcacgcttcataacacggcgggcaggaatctcatatgcctcggcaatcttcatataatccggattcaacatcggagtaaatgaataacgatgaccaaaaaacatagcttgccattgacgaacattacccaaatagttattgttcaataaaataatctttaccggtgctttttgctccatgatagttcccaattcttgaatattcatctgcaaaccgccatcccccataaatacgcatacagtacgatccgggcgaccgaaagtagcgcctatagcagcgggaagaccgaatcccatcgttcctaatccacccgaagttacaatgctacggttcttactgtatttaaaataacgagcagccatcatttggttctgtcctacatctgtcaccaatacagcctcgttgttcgaagcctcacttaccgcacgcaccacttcacccatattcaacgccccgtcaacaggatgaatttctttactgataacatgttcatattccgtcttttcatattcagtaaagctatcaatccattcggaatgttcattcttccggataagttgcgtcagcatagctagcgtatatttacaattacctaatacgggtacatccacttttacattcttatctatttcagaatggtcaatatccaaatgaatcacctttgcctgtttagcatatgtatctaattttccagttacacgatcgtcaaagcgcatacctacagcaatcaacacatcacattcattagttttgacattgggccccagatttccatgcatacctaacattcctttgtttaaaggatgcgaagttggtatagccgaaagtcccagcaaagtacagccacaaggcatatcggctttttctataaatgcacgtaactcatcttgcgcattacctaactctaccccctgtcctaccaacactaatggcctttgagcattgtttatcaattcggcagcctcctgaagagattccttatcaggattaggttctggatcataactacggataaaatcaagcttcatcggttcataatccaccatctccacttgtgcattcttggcaaagtccaaaacgacaggaccgggacgtccgcttttagctatatagaaagcacgggctacagcccaagctacatcttccgcacgacgaatttggtaactccatttggtaataggctgagtgatgcccaccagatccacttcctgaaaagcatccgtacctaaaaaggaagctcctacctgcccggcaatcaccacgataggcgtgctgtcaatcatagcatcggcaatgccagtaatggtatttgtcgcaccgggcccgctagtcaccaaacagacaccaacctcaccggatacgcgggcaaatccctgtgctgcatgggcagctccttgttcatgacggaccaatatatggttcaatgtatttctatgatgatataaagcatcaaaagtaggcatgatagaacctccgggatatccgaaaagagttttcactccttgatactccaaagaacgcatcatcgcctctgctcctgttatcttttcttttgccataattgtttagttgagaattgagaatcaaaaaaatacgatgccggacaatcgaccaatgacaacaaatctattttttttattctcaatttttaatttctaatttagtcaatgattctcactcctcctttatctgcagaacttaccatactagcgtatgccttcaagcttttaggaactttacggtcacgggtcaccgctgtcatcggtcgggcggccaattcttcgtcactcagtttcacattgatactgcgattcggaatatcgatttcaattatatcaccatccactatttttccgatattaccacccgctgcagcttcgggagaaatatgcccgatgcttaatcccgaagttcctccactaaaacgtccgtcggtaatcaaagcacattcttttcctaaatgcttggatttgatataggaagtaggataaagcatttcctgcataccgggaccacctttcggaccttcatgagtgataacaacaacatctccgctgactacttttcctcctaaaataccttcacaagcagcatcctgcgaatcaaacaccttggcaggccccgagaatttccaaatactttcatccactccggccgttttcactacgcaaccatcctgtgcaatgttccctttcaaaacggccaaacccccatctttactataggcatgttgcaaatcgcggatacaaccattggcacgatctgtatccagttctttataaacagcattctgagaacctaactttatattgaatttgtttcccggagcacttgaataaatacgttttgcttcagtatccacttctttcttacatatattatatttttcgacagcttccgccaatgtcaggccgtccactcgtttcacatcagttttcagcaaaccacccttggataattctcccaatatattaaggataccaccggcacggttcacatcctggatatgatatttctgtgtattcggagctactttacacaaacaaggcacatggcgtgaaagcatatcaatatcatccatcttgaaatctacttccgcctcgtgggcgatagctaaaagatggagcacagtattggtagaaccacccattgcaatatccaatgtcatggcattcagaaaagcgtcacgagtagcaatgttgcatggtaacacgctgtcatctccctcctcataatatttataagcattcttcactatcagagcagccgcatctttaaacaactgagtacggttggcatgagtcgccaaaatagtgccattccccggaagccccagaccaatagcctcattgaggcaattcatggaattagccgtaaacatacccgaacagcaaccacagccaggacacgcattattttcaatttgagccacatcctcatcgctgaccgatgcatcagcagatttaatcatggcgtctatcaaatcaagatgctggttattccattctcccgcttccataggaccacccgatacaaaaacagccggtatgttcagtcgcatggcagccatcagcatacctggagtgattttgtcacaattactgatacacaccattgcatccgccttgtgagcattcaccatatattccacgctgtcggcaatgatatcacgactgggcagtgaatacagcataccatcgtgtcccatagctattccgtcatcaatggcaatcgtattgaattctgctgcaaaacatcccaatttttcaatctcaactttcacctgctgacctatttcatgcagatgggtatgtcccggaacaaactgtgtaaacgaatttactatggctataatgggcttgcccatcatttcttttttcatgccgttagccccccataaagctctcgctcctgccatacggcgaccctgtgtgctaaacgaactgcgtaactgattcttcatcttattctaaatctataacgtcctatacttattgaaaaagccttcctcaccatgtgagaaaggcttccaattatttctttatatgtacaactacacatacacaacctttctcacgctcctagtgtgaccaccacgacgcgaataatatgcaggactgctaggttatttagagtagtaatattcatatatctgttttctttgtttctttaacgactgcaaaggtaaggcgtttttcgtaacaaacaaataaaatgaagattttttttcttataaattattattcgtaactaaatcgagctttaaacaatcattttatcacaaatatacactgtatcttccaacggataaataaaaaagagaatgcattggtttgcattctcttttcagttcatttatttcattttataaatttacttattcgccacatcttccatataggaatccaaccccttgtttttcaatgtaacattcaacaactgtacatacttcttgtactgctcatttgtcaatgtacgtttcatcagtttgaagtttccatatacggcttcacgcaattttttaccttgtttagcttcttttgcgtagcttgcgctttgtactttgtcagcaaaataatcagaaatattagcaacttcctccatctgacgtgcatccaaattcaaatatttgctcaactttgcgacgttaacatctaccttccaatctttaccttctactttttctcctgcaaaacttgtagctgacattcctaatgccactacaaccaacaatactaaacgtttcataatacctaaaattttaatttgttaaacctaaaaacaatttatttagtacctaagaactaaataataccttttaaaaacaatctcgttatctctttctctttacactgcaaatataacaacatgctttacgacatgttgtcatatatccgttaattaaagcaaaaatctatcaaggcgagcggttaattgatttatatcaaggatcaaacgcaatcaaaagcgcatttatagtatcataataacaaatttatgtaatataaacgtaataacaaaggattaaggggaattaattcgtatctttgccaacaaaaaacttacgtaaatagtttatattacattattataataagaaaacatggaaaataagtacatcaccgtagcatacaaactttatgtaatgcaggacggccagaaaacattggtagaagaagcaactgtagaacatcctttccaattcatatccggattaggaaccacactggaacgctttgaaacagaaataacagccttaaagaagggtgacaaatttaaatttgtcattcctaccgcagaagcctacggagaatatatgcccgaaggtgtgcgcactgtatctaaagatatgttcaccattgatggtgtttttgatgaagaacgcatcttcccgggagctgtcattcccttacaggacaatgagggacatcacttctacgctaccgtaagcgaagtaaccaatgacactgtaactgtagatttgaaccatcctcatgcaggtaaagatctcacttttgaaggtgaagtagtagaatcccgcacagccactaatgaagaaattcaggaaatggtaaaaatgatgagtggagaaggatgcggctgtggttgtggtgactgcggagaaggatgcggtgatgaaggtggatgcggatgcggacattgtcattaatttcgttaaacaatagataaagaagaggacggaacaaaacatccgccctctttttattattgataacgaaacaatactgattggcagcttcagtgtttcttcaaacatttcaaaaaaaagaacttgaagttttcaaaaaagatctagttcttttctattaaacatctagttcttttaaaaaaagaactagaccttttttaaaaacgtccggttctttttgactataggaccggttatcttgattcataggcgaaacaaatgcatttagctgggtaataaacacatttttcttctattgcaagacacagataataagactaaagaataacataatgtaacaaagaagttaaaaatgaacagagagaatgccaaaccgtttgcccattccaaacactatctgtatttttggcagaaatattctgatcaaatgaatgagaatgtccttgccaaattgaaaatactcgcagaatctgctaaatatgatgtttcctgctctagtagtgggaccgtgcgccgtaaccaatccggcgcattgggaaacaccgtaggcggctgggggatatgccatagcttcgccgaggacggtcgttgcatatccttgctgaaaataatgctgaccaattattgtatctatgactgtgcctattgtatcaatagaagaagcaatgacattccccgcgccacgctttcggtaagcgaactggtagacctcaccatcgaattctaccgacgcaactatatagaagggcttttcctcagttccggcgttgtacgcaatcctgattacaccatggaaaggttggtacgtgttgccaaagacctgcggttagtacacaaattcaacggatatattcacctgaaaagtatccccggagccagtcgcgaactagtcaatgaagccggactctacgccgaccgtctcagtgtaaacatagaaattcccaaagaagagaatctgaaattactggctcccgaaaaagatcacaaaagtgtataccagcccatgcgctatatccagcagggaatacttaccaacaaagaagaccgaaaaaaattccgccatgttccacgcttcgttcctgccggacaaagtacgcagatgattgtcggtgccacaaccgaatcagacaaagacatcctttatctttcttcttcactctaccaacaccccaccatgaggcgcgtctactactctggatatatatccgtaaatacatacgacaaacggcttccggcactgaaacagccgccattggtacgtgagaaccgtttgtatcaagccgactggctgttacgtttctatcaatttaaagtagaagaaatagtcgatgactcctatcctgatctagatttggaaatcgaccccaaattaggttgggcattacggcatccagaacaatttcctatagatataaaccaggcagattacgaaatgattctcagagtaccgggtatcggaatcaaatcggcaagacaaatcatcgcgtcacgccgcttctcaaaactgggattctatgaactgaaaaaaataggtgtagtgatgaaaaaagcgcaatacttcataacctgcaacgaactccccacccggactgttaatgaactaactccgacaggagtacgcagactgttagtacccaaacccaaaaagaaagtggacgaacgccaattaatactaaactttactgataacgaatgattctgtttatctatgaccatacatttgaaggcttgctgacttgcattttcgatgcttacttccgcaaaacctttcctgacttgctcttgatggaaggcgagccgctacccttgttttacaatgaagccatacacatagccactgatgaagagaaagccggacgcgtgtggcgcggattacagaaaaaaatctccaagcatgcccttttcagcttgacctgctgctggttatcagaattaccaaaggtggacgaaatgcttttccactatatccagaaggccataaactctcctcattctattgagaccaactttgccgatcctgatgtgctggagcttgcgaaaatctataaaagagtagatggagaacgagtacacctcatgcagttcgtccgtttccaaaaagcagcggacggaactttctttgcagccgtaaaacctcaattcaacgcactgccactggctgtggatcatttcaaagaccgttttgccgaccagcgttggctcatttatgatgtgaagcgacaatatgggtattactataatctaacagagatggaagaagtaacatttgaagatccccgccaagcacatctggtcacaggaatgctaaatgaaacattgatggacaacaatgagagattatttcaggaactttggaaaacatatttcaagtccatttgtatcaaagaacgttggaatccccaaaaacaccggcaagatatgcctgtcaggtattggaaatatctgacggagaaacaataaacagttcttccggatatcccacatctactaaaaacaaggcatgtcccggcacagaactaccggcactacaacgatctttattctctatcaccttcctgaacccatctaaagtcattttaccacgccccacttccaccagcgtacctaccacagcccttaccatattccgtaaaaaacggtcggctttaatagtaaatacccattctgttccactcacccgcgtccattcagcatacataatccggcaattattcgtcttcacatcagtatgcaatttactgaaactggtaaaatcagtataatcaaacaatacacgggcagcctcattcattttctcaaaatccaatgaattaaaaagcctccaagcataatgacggttaaacggatctttccggatagtcacataatacttataagtacgataagtcgcgtcaaaacgggcatgcgcatcatccttcacccgcttcacatcgtaaaccgctatatcggaaggaagcaagcgattcaatttctccgttatctgaacacaatccaactcctggtcataatcaaaatgcgcgaccatgagacgtgcatgcacgccggcatcagtacgtcctgctcccactacctctatttcttgacggagaaaagtagaaaaagcacgcattaatgtttcctgtacactgtcaccattgggctgaatctgccaaccgtgataatttgtcccatcataagccaaatatatgaaataccgcatcgtaaagcctctaaccaagtgaaaattcaataattcagcgggctgttatatgaaaacatccctgtttcaactcatatttgatatagcatttgtccgacttccgaagatcacggagtacctcggccaataccaacttcagcgtatccggactaacatcctgcataggacgtccatccggatcttccactttacaaaaccgacggtaactgacatcgaaagttgtcccaaaagcatgagctgaattagcagaagcatttccattgcgacgacgaagacgtttcacatcatctgccgtacgaagtacagaagtaacaatgatttgattaggattcaatcctttgcaactcaatgaatccaaaaaattggctcctattgtatccaataacgcactagcttgcggaatcagaaaaggaatggagtgagtcagcgaatccatagcataacgctcacaaggttttatctggaccaatttaccacccaatccctctgcttccgaacgagaagccaacgggcgaattcctattttcttcgctacactgagatgagtatcattcaaatcaccgaaactacgtttatagctaattacaccttttatattatgaggctcattcatcttcatggacatatctttttccttgcaaccggaagaaactgtcaaggaaaacaaaagtgacaatagcgtgcaacatgcacctttcatacaattcataatctaactatcttttcaaattcctcgcaaagatagattaaaatcctttttctgaaaaagcttatgcaaataaattgcccggaaaataagaacaatgaaaacctttcattaaatttgcaccctataaacaagtacgtaaagtacctaaactagttaaatgatagaaaaacatatagttttagaggatattgatcctgttatattttatggcgtaaacaacgtcaatatgaaaatgatacaagctttgtatcccaaattaaaaattgtggcacgtggaaatgtcatcaaagtattgggagacgaagaggaaatgtgtgcttttgaagagaatatattggctttggaaaagcattgcgcccagtataattcactgaaagaagaagtgattttagatatagtgaaaggtcgttcaccccaaatagagaaaacaggggatactattgtattcagtgtaacaggaaaaccgatcgtcccccgtagtgagaaccaattgaggctggtacaagaatatgagaagaacgatatgctgttcgctatcggtcccgcaggttcaggaaagacctataccgctattgcccttgctgtccgttctctgaaaaacaaagaaatcaaaaaaattattttgagccgtccagctgtagaggcaggagaaaaactcggatttttacccggtgatatgaaagataagattgacccttatctacaaccactatatgacgcattacaagatatgattcccgccgccaagctaaaagaatatatggaactgaatgtgattcaaattgccccattagcatttatgcgcggacgcaccttgaatgacgctgtagtgatattggacgaggctcaaaataccaccacccagcaaattaaaatgttcctcactcgtatggggatgaacaccaaaatgattgtaacaggtgacatgacacagatagacttaccatcttcacaaacttcgggattgatacaagcactaaaaattctgaaaggcgtgaaaggaatcagtttcatcgaactcaacaagaaggacattgtacggcacaaactggttacccgcattgtggaagcatacgagaagtttgaagaaaaacagaaaacccttcattcatgccattctggacgaagtgaaaaatctgaaaacataaaacgaatttattgattttaattataaataaagacatgagtaaagcattaacaagaacagactttaactttccgggacagaaaagtgtgtaccacggcaaagtgcgtgatgtatacaacatcaatgacgaaaagttagtaatggtagctaccgaccgtatctccgcattcgacgtagttctgcctgaaggtattccctacaaaggacaaatgctgaaccagattgcagccaaatttctggatgcaactactgacatctgccccaactggaaaatggcgaccccagatcctatggttaccgtaggagttatgtgtcaaggttttcctgtggaaatgattgtccgtggttacctgtgcggtagcgcatggcgtgcttacaaaaacggcgttcgcgaaatctgtggtgtacaacttcccgaaggaatgaaagaaaaccagaaatttcccgaaccaatcattactccaaccactaaagccgaaatgggcctgcatgacgaagacatctctaaggaagaaattctgaaacaaggtctggctactcccgaagaatacgaaatattggaaaaatatacattggctctgttcaaacgcggtactgaaatcgctgcagaacgcggactgatcctggtagataccaaatacgaattcggtaaacacaacggcactatttacctgatggatgagatccacactccggattcaagccgttacttctatttggaaggttatgaagaacgctttgcaaaaggcgaacctcaaaaacaactttctaaagaattcgtacgcgaatggttgatggaaaatggtttccaaggcaaagaaggacaacaagttcccgaaatgactccggaaatcgtaaattctatcagcgaacgctacatggaactgttcgagcacatcaccggcgaaaaatttgtgaaagcagacactgaaaacatcgccgcacgtatagaaaagaacgtaaccgaatacttgaaataaataaaaatgaaaaattaaagattaaaagacaagtacaggaatccaaaaatcctccaccctctccttttaatctttaattttcaattttaattaaacatgaactacccacaagaaaaaatcaagccctacaacgctgacgaaaagaaaagcgtccaagtagagaaaatgttcgacaacattgcccctgcttacgaccagttgaatcatgccctttcatggaatattgacaaaagctggcgccgcaaagccattaactggctgaaaccttttcacccgcaatacataatggatgtagccaccggaacgggcgattttgccattcaagcctgtcagacacttcacccccaagagctgataggtaccgatatatccgaaggcatgatgaatgtgggacgtgaaaaagtaaaagccgccggactggacagccgtatctcctttgctaaagaagactgtacagcacttacctttcccgacaaacgctttgacgctattaccgtagcattcggtgtacgcaatttcgaggaccttgacaaaggactccgcgaaatgcaccgcgtactgaaagacaacggaaaactagtcattttggaactctctgaacccgactggtttcccatgaaacagctatatgctgtctattctaaaatagtcatccccactttgggcaagctactctctaaagaccgtagtgcctacacttacctgccgcaatccattaaagcctttccacaaggcgaaataatgacagacattatccgtaaagccggattcaatcaggtgagtttcaaacggttgacgctaggtatctgtacgctttatttagcaacgaaataatttaaagtatagagttttatgaaaaaatatggtttgataggttatccgttaggacactcgttctcaaagaactttttcaatgaaaagtttcattcggaaaacattgatgccgaatatgtaaactttgaaatcccatccatcaaagaactgccttctgtgttattggctaatcctgatttagtagggttcaatgtcactataccttataaagaacaagtcatctcttatttggacgaactggataaagatgcggcagccatcggagccgtcaatgtaatcaaaattgtccgccaaaaaggtaagaccaagctaataggctataattccgatgtgattggtttcactcaatctatcgaccccttgttggaaccccagcacaaaaaagctctgattctaggaacaggaggtgcctcgaaagcaattgcctacggactgaaaaaattaggtttggaatgcaaattcgtatcacgaaacctgcgtgaagaaatgctgacttacaatcagctcactcccgaaatcatggatgagtataaagtaattgttaactgcactcctgtaggtatgtatccccgtgccgatgaataccccaatattccataccaatatctcacacccaaccatttgctttatgatttgttatataatcctgacactactctttttatgaaaaagggggcagacaaaggggcaattaccaaaaacggtttagaaatgctcttattgcaagcctttggtgcatgggatatatggaacaaatagataaggtatgaaaagaaaaaaaatgattattggaacgagttgtatattcgttctgcttattatagtcctacttggagccagtcaatatatgctggactattccttacgccctaaaaacaggggaaagaatttagaaagttcctggcaatatatgtttaagacttactcctatctaaaaccatggatagatagtctgaaacagaaccaagcactgaaagatacctttatctattctcccgaccacgtaaaactgcatgcttactatgtggcttccagccgcccgacagccaaaaccgcagttatagtacacgggtatacagacaatgccatccgcatgatgatgataggttatctatacaataaaaaattggatttcaacatcctcctacctgatttgcgcaatactggtctgagcggtggaaatgccatacaaatgggatggttagaccgcaaagatgtaacacaatggatggaggttgccaatcgaatttacggtgacagtaccagcatggtagtacatggaatctcgatgggtgcagccaccactatgatggtttcaggcgaaccgcaacccgactatgtgaaatgttttgtcgaggactgcggatataccagcgtatgggatcaattttccaaagaattgaaagaacaattcggcttgcctcaattcccgttaatgtacactgccgactggttatgccagctggaatatggatggggattcaaagaagcatccgcattgaaacaggtagcccgatgccatctgcccatgttctttatccatggtgataaagatgactacgtacccacatggatggtgtaccaattgtatgaggcaaaacctcagcccaaagcattatggatagttccggaagcagaccatgcacactcctatctgttcaataccgaagaatatacccaaaaagtaaaagcatttgtagacaaatacatccaatgagaaaattgacatttttacttacttttttcatgctccttggctccgtccaccttcaagccaaagaatatgccataaaagacataccgatggtacatttgcaaaaccgtacccgctacgtcagcaatcccgacggtatcctttcatcaaccgctgtcaccactatggacagcatcctctacgctttagagcaaaaaacaggtatacaaacattagtggtagcggtaacaggcatagagggaggtgattgttttgatttcgcccaccggctgggacaggaaacgggcgtaggacaaaaagaacgtgacaatgggctggtcatcttgctttccaccgacgagcggtgtgtgcagttcgctactggatatggtcttgaagggatattgccggatgccatctgcaaacggattcagaaccgctatatgctgccctatttcaaggacaataactggaacgcaggaatggtagcaggaatacgggccgtaaacggctatctggacggttccatggaaaatataaacaatgacgaaagcgaagatgatcctttggaattcatcatcatcttttttgtgattttcggaggatttattggcatcggattatatgcaaactggcgtaaaacacgctgcccccattgcaaaaaacacaaattgcaacgtctttcttccaaagttatagaccgaagtaacggaacaaagactgaagaagtagtatataaatgcagaaattgcggacatatcctcagacggaaagaacggtcgagagatgagaattacaaaggtccccgaggaggaggtccgttcataggcggaatgggaggaggattttttggtggccacggtggaagtggcggcggatttagcggaggaagtttcggaggtggaagctttggaggcggaggagccggaagccgtttttaagaacaagaatattcataattttaatagtatatacatatgaaaaagtcaacgattattgtaatagtagtcattgtattaattgccatttggggaataacctcttataatggtatggtaaaaatggatgaatctgtcagcacagcgtggagcaatgtagaaaaccagtaccaacgccgttctgatttaatccccaacttggtaaatacagtaaagggatacgcctcacacgaaaaagaaacttttcaagctgtagtagacgcccgtagcaaagccactcaaatgcagatcagcgccgatgacctgactcccgaaaaaatgcaggcctatcaaaaggcacaaggcgaagtaggtagtgcgttgagccgcctgctcgctatcaccgaagcttatcccgacttgaaagccaatgagaacttcaaagagttgcaagcacaactggaaggtacagaaaaccgaatcagtgtagaacgcaaaagattcaatgacacagcacgcgcatataacacagctatccgcacttttccccgcaatttgcttgcaggtatgttcggatttgacaaacgcccatattttgaatctgaagaaggagctgataaagcacctaaagtagaattctaacttttacaagtccctgtttccaatcttaagaaacagctttcgggtacggattgtagaaaccatgcagtttttttatgccaaactgtaaaaatcatacaatccgtaccctatttttatccatctcactaatttttcaacaacaatcaagcatattatccctaaaatcattatctttacggaaagaaacttttaaaactacaagcaatatgttcaattcatttggtaatattttccggttaaccagtttcggtgaatcccatggaccgggagtaggcggcgtcattgacggcttccctgccggtattaaggttgatatggatttcgttcagcaggaactgaaccgccgccgtcccggacagtcattacttaccaccagccgcaaggagcctgatacagtggaattcctttcaggtatattcgaaggcaagtccaccggttgccccatcggatttgtggtatggaacaagaaccaacattcaaacgactacgagaatatcaagaatctgttccgcccttcacacgcagattatacttatatgcaaaaatacggaatccgtgattaccgtggcgggggacgttcatcagcacgagaaaccatttcgcgcgtagtagcaggagctttagccaaattagcattgaaacaactaggaatcagtgtcacagcttatacctcacaagtaggatctgtcaaacttgataaagattacaaaagctataacctcgaattgatagaaacaaacgatgtgcgttgtcccgatccggggaaagccaaggaaatggcagagcttatctggaaaatcaaaggagaaggcgatacaataggtggtgtagtgagttgcctcatcaaaggatgccctatcggattaggccaacccgtattcgggaagttacatgccgcactaggaaatgccatgttaagtatcaatgccgtaaaaggtttctcttatggacaaggttttgactccatggaactaaaaggcagcgagcagaatgatgtattttataataataatggaagagtagaaacaaaaagtaattattccggaggaatacaaggaggcatcagcaacggacaagacatttacttccgtgtggcattcaaaccagttgccacaattctgatggagcaacatactgtaaatatcaacggcacagacacgaccatgaaagccaaaggacgtcatgacgcctgcgtgctgccgcgtgccgtccccattgtagaagccatggctgccatgaccattttggattattatctgatagacaggactacacaactataagaatcattcaattatggaaataaaacaatacattaaagaaaatgaagcgcgcttcatggaggaacttttcagcctcatccgcattcccagcatcagtgctttacccgaacataaagacgatatgctggcctgtgccttacgttggaaagaacttttgttggcagccggagcagatgaagccatagtaatgccctcacaaggcaatccattggtatttgcacaaaagcatgtaagcaatgatgctcctaccctattgatttatgcccactatgacgtaatgcctgccgagccgttgggcctttggaaaagccaaccttttgaacctgaaattcgcgacggacacatttgggcacgtggcgctgacgatgataaaggacaagctatgatccaagtaaaagcattcgaatacgtagtaaaaaacggactgctgaaacacaatgtgaaatttattttcgaaggtgaagaagaaataggttctcccagtctgaataccttcatcaaggaacataaggaattgctgaaagccgatgtaattctagtttcggataccagtatgctaggcgcggaccttccctctctgactacaggtttacgaggtctggcttattgggaaatagaagtgaccggtccgaaccgtgaccttcattccggacacttcggcggggcggtagctaatcctatcaataccctgtgcagtatgttagcccaagtcattggcgaagacggacacatcactatcccccatttttatgacgatgtagagaaagtaccggctgccgaacgtgagatgattgcacaaattcctttcgatgaaaaaaaatatatggaagccattggcgtaaaagcactgaaaggtgaaaaaggatattccactttagaacgtaatagctgccgtccctcttttgatatttgtggtatctggggcggatatacaggtgaaggttcaaaaaccgtacttccctcaaaagcatatgccaaggtatcgtgccgactggttccacatcaaaaccacgcagttatttcccaattgtttgtggactatatccagtctatcgctccggaatatgtacaagtaaaagtaaccccgatgcacgggggcgaaggatatgtatgccccatcaccttgcccgcctatcaggctgccgaaaaaggctttgctaaagcattcgggaaaaaaccacttgccgtacgccgtggaggaagtattcctattatcagtgattttgaacaaatcttaggtataaagaccgttctcatgggattcgggttggaaagtgatgccatccattcgcctaatgaaaacttctctctggatatattccgtaaaggaattgaagctgtggtagaattccatctcaattattaatcaataataaaaatgaatgcggcaacaatctttaaaactctgacaactgttactctttcaataacattactaatgacaggaggttgtaacaatatggaaacaaaaaaagaagaaacaggaaaaaacacggctatagaaaatatctttgcccgaaagagcgtccgtgcctatacatcccaaccgatagaaaaagagaaagtggacttattagtaaaagctgctatggctgcaccgacagcagtaaacaagcagccttgggctttcgtggtagtggatgaccgtacagtattagataaactagccgccgaactgccttatgccaagatgacggcacaggctccactagccatcgtggtttgtggtgatttaagcaaagctctgaacggagaaaaagaccggtactggatgctagattgctccgccgcatccgaaaatttgttactggcagcagagtcaatggggttgggagcggtatggactgcggtctatccggagaacgaccgcattgcaaaggtaaggtcagtcttatctttaccagaccatatcattcctttcaatttgatcccagtgggttatccacaacatcgggaagaatctaaagataaattcaagaccgaaaatatccattataataaatggtaaacaaaggtctagaaatataaattaagtcggctggtttaatataaatcagccgacaatctctttccattcattcatagttaattttcctcaatctctagcagcctcatcaagtttctttttggtcttttctatcttgtttttagctttatccaaagtttccccaacctcatcagctttatcctcaatctgatccttggcatcatccatcacgtcttcaaccgattctttggctttttctatacgctcctcaaatttatcctttcctttcttttcaccacaagatgtaacagcaaacatcgtcatgcacactaacactgcaaataattgtcttttcatactttttctatttgattataaacttgattttaaactatgttcaaatataagcatataccctatttcttacaaattcaatctgttctttgctatatataaagtctaaatccgacagaaaaaagaacttatcccatcaaaaaagccaccatagcaaggtggctttcaatatattaataaaacattctatattacctgtcaaaaactactttgtagcaggagctgttttagcaggagccgtctttatattaataagaatactattttcaactccttctttggttacatatactattctgtatgcctttaccccttcttcttttagagaaagagaagcacttttaagagtcgattcgggatattttttagctatggcatctttaacagattgaggaacctctttcaggtctatgtttttaaatccgtcttccacagtaactgtatcattctttactttcatggtatcatcagccatgacaaaagttcctacaccaaaaaggaatacaagtgataaaaatatctttttcataatggttaaatttaaatgtttacctaccgacagatatcataaaagacaagaaaaatatacatcatattcagtcatttttctccattagaatatcttcgttaagtaagaatactaaattaagaaaactatattgagaactaaattattaagaaaagaagtacataccaaatatataaactaaagtttgtggaaataaacattctttaatccacaccagcttatgctttcacagccctatctattccaactttcctagccattaagtaaaaaagcttctgtagagatagttgtacaaacgtttggcataatgccgcaaaatacgtacttttgcgactcatttataaaatactatttgaatgaaagcactaaaagaacgcattttacgggacggaaaatgtttcgaaggaggaatactgaaagtagacaatttcatcaatcaccaaatggatcctatcctcatgaaatccattgctgtagaatttgtacgccgttttgcctctaccaatatcaataaagttatgaccatcgaagccagtggtatagctcccgccatcatggtaggctacttactggaacttcctgttgtcttcgccaagaaaaagaaacccgtcacaatggaaaatatgctcaccaccagtgtatattcatttactaaagaccgttcttatgatgtatgcgtcagcaaagatttcctgtccaaaggagaccgtgttctttttattgacgactttctcgccaacggcaatgcagccaaggggatcatcgatttggtagaaaaagccggggccgaactatccggaatgggattcatcatcgaaaaagcattccaacatggcggagattatttgcgtaatgcaggtatccgcgtagagtcattggccatcattgaaagtctggacaattgtgaaatcaaaataagataatcccatgcaggaatctcaaaccgcccaatccaataccggactgatttacggattgaacgaccgccctcctgtacgagaggccatttttgccgccatacagcatttgcttgctatttttgtagccatcattactccgcctcttatcatcgctggagcattaaaactggatttggaaacgaccagtttcctagtatccatgtctctctttgcctcaggtatttctacctttatccaatgtaaacggataggaggtatcggcaccggccttttatgtatccaaggaactagtttttcatttattggtcctatcatctcggcaggtatgctgggcggacttccactgattttcggcacttgcatcgtggcatcatctgtagagatggtcatcagccgcatcttaaaatatacccgtaaaataatcacccctctggtatcaggtattgtagtcactttgattggaatgagcctgataaaagtaggtatcacagcttgtggcggaggtgtctccgcccaaagcaacggcactttcggaagttttgagaatctaggtctagctctactggtactcattctcattatcctttttaatagaagttccaaccgctacctacgcatgagttccatcgttatcggcttgattataggatatttagttgcctggggtctcggtagaattgatttctcggcagtacaaagttttggtggtttcaatattcccctcccattcaaatacggactggatttcgacttctccgcattcatagctttgggattaatatttttgataacagccatagaagcctatggagacattactgccaattctctgatatcaggagaacctgtagaaggaaaagtattcatcaaacgtgcttcaggaggaattttggcagacggattcaattcgatgctggcaggtattctcaattcttttccaaactccgttttcgcgcaaaataacggcatgatacaactgacaggagtagccagccgatatgtaggctattacattgcaggtttccttattttattaggattatttcccagtgtaggattaattttctccctaatgcccgaacctgtattgggaggcgctactttactgatgttcggaacagtggcttcagcaggcattcgtattatcgcagcacaaaagattaaccggaaagcaacattagtcatcgcacttagtttcgctttaggtttaagtgtagaaatggttcctgaaatactatgtcaatttccagaatcaataaagaatattttctcatccggcattacaacaggtggagttactgccatcatttcaaatgcactgatacggatgaaagagtaaaaacaagtaattttctcataaattggaactaaagcattaactttctttgcaaatcagcaaaggaagggagaataatatatatctttgctccaaaatatgattatgactacagaggatttacagaacctatatcaaacttacctcggagaagtacccgaagagattgtagaattaccctcatccggttccaacaggcgttatttccggctgaccggaactaaaaaactgattggcgtatacggcacctccaaagaagaaaatgaagcctttctttatatggcagcacacttccgcaagaaaggtcttcctgttccagaagtatacatctgttctgaagacaagaattgttatctgcaagaagatttaggagatatccttttattcaacgctattgaaaaagggcgggcgaccagcgtcttctccgaagaggagaaagaaatgctgcgcaagaccatccgcttactgccttctatccaatttgccggagcagacggctttgatttttcacactgttatccccaagccgaattcaaccaacgttctatcctttgggacttgaactattttaaatactgctttttgaaagctaccgggctggagttccaagaagacaagctggaagatgactttcaaaaaatgagtgatgtactgctacgcagttcttccgccacttttatgtatcgggatttccaaagcagaaacgtgatgataaaggatggagcaccctggttcattgatttccagggaggacgtaaaggaccgtttttctatgatgtagcctctttcttatggcaggctaaagctaaatttcccgaaactctgcgcaatgaactgttggaagaatatatagacgccctatgtaaatataaacccgtagaccgtgattatttcttcaaccaactgcgtcatttcgtgctcttccgcaccttgcaagtattgggagcttacggtttccgtggctatttcgaaaagaagccacattttatccaaagtgtaccatacgccattgagaacctgaggcaattacttcataatgaatatcccgagtatccctatttatgctccgtactaagggaacttaccgaactgaagcagttcaaggatgatttgaagaaacggcaactcacagtgaaagtcatgagtttcgcctataagaaaggtattcccgatgatcctacaggcaacggtggagggtatgtcttcgattgccgcgccgtaaataatcccggaaaatacgaacgttataaacctttcaccgggctggatgagccggtcattcgctttctggaagaagacggtgaaatattcccatttctggatgctgcttattctttagtagacgcttcggtaaaacgatatatggaacgcggattcagtaacttatctatatgttttggctgcacaggaggacaacatcgttctgtttattcggcacaacacatggcagaacacctcaataaaaaattcggtataaaagtagagttaatacaccgagaacagaatatagaacaaacatttgaaagaacattatgaaagcaatgatttttgcagccggactaggcagccgacttaaacctttaacagacacccggcctaaagcattaataacggtgggtggaaaaaccatgttagagcacatcatcttaaaactgaaagcagcaggatttgatgaaatagtaatcaatgtacaccacttttccaatcagattctcgcttttctggaagctaaccagaacttcggaatcgatatacaaatctcggacgagacagactgtctgcttgatacgggcggcggtttggaaagagcatactacttattacatcatcctgaggatatgtttaccaaagaaggcgaaactccgtatgaactgatattcgaaaatctgatgaaaggaatggatgaggaagaaataatcgaaagaggcttaggaattatgcggaaagaatgctacttgctccacaatgtagatatcctttccaattgcgattttgaaagtcttatgtattatcatcagaatagttctaacatcaatgccacccttttagtcagcccacgcaagacctcccgttatctgttgtttaatgacgacaatctgttacgtggctgggtcaataaagacaccatggaaaccaaaccggcaggactccggtataaagaaggggaatatcgggaatacgcctatagcgggatacaagtgactactcctaaaattttaaatctccttcccagaggaaaatattccattatcgatttctatctctccatatgtcacagagtcgacatccagtgctatgtagaagatgatttgcaattgcttgatatcggtaaaccggaaaatctggaaaaagcggaagagtttctcagtaaattataaccagtccaagaaatatatccaataaaacagcttcttattctttcggataaaatgggcagataaaaaaagtcgtaactttatgaagtgccccccaaaagttttgtgtctaacttttgggggacacttcattatgaccaaaggttcaatttatttttttgagcttcctccaaagataccgtttttacctgtttggtactgtttttcagacgaagttcctcatattctttgttcagcctttccacaaattcagaagaagattccggattcagcaaacgggcggctaccaaggcattctgtgaagcatctttcatgtgaatgaccggacctccataaacaggtgctattttcaaggcagtatgcagcttggaagtagtggctcctccaatcataatgggaatgtccagccccgcacgctttaactctacagccacatgcgccatttcttccaatgatggagtaatcagcccgcttaatcctattatatccaccttttcctctatagccttccggactatcatttcagcaggaaccatcacgccaaggtctataatttcatagttattacaagccatgaccactgatacgatattcttcccaatatcatgcacatccccttttacggtagccatcaatacctttccagcgctgcgggcaccttcttgtttatcagcctcaataagaggttgcaaaatagctactgcctttttcatggtacgagcagtcttcacaacttgcggtaagaacattttccctgctccaaacagctctcctaccctattcataccttccatcaacggaccttcaataatatccaccgccttaggatatagtttcaccgcttccgccaaatcttcttccaagtgatcaccaataccttttatcaaggcatactgaagacgtttctctaccatcggttcctcacgccacacatcctgctttacggcttctgttccggtcgccgtatttttcaatgcctcagcagtttctatcaaacgttcggcagcatcgggcctacggtttaagactacatcctctatccgttccagcacatcagcaggaatatctgtataaagcaccgaagtagcaggatttacaatacccatatccataccttgacgaatagcatgataaaggaatacggcatgcattgcctcacggatataattatttccacggaaagagaacgacagattgcttacaccaccactgatatgtgctccgggtaaattcttctttatccatccggtggcattgataaagtctaccgcataattattatgctcttcaataccagtagccacagccagtacattgggatcgaaaatgatatcatgaggattaaagcctacctgctccgtcaatattttataagcacgggcacatacttcaattttacgttcaaaagtatctgcctgtcctttctcatcaaaagccatcaccacagtggcagctcccaatttctttatcagacgggcatgttctataaatttctcctccccttccttcaaagaaatagaattgacaatagattttccttgcagacatttcagtccggcctcaatgacttcccacttggaagagtcaatcatgatgggtacacgggctatatcaggctcggacatgaccagattcaagaaagtagtcatctcctcccgggcatccagcaaaccgtcatccatattcacatcaatcaccaaagcaccgtcttccacctgcttgcgggcgatacttagcgcttcctcatatttcttttcattgattaaacggagaaatttacgggatccagccacattgcaacgctcacctacattaataaaattcatttcgggagtctgctccaacagttccaacccggaaagccacagcctctcaggagtggtggcagggatatgaggaggcacccaggcagaaccggaaacaatcaattcctgatattttgcaatatattcctccgttgtaccacaacaaccaccgataatgttcactaatccttcatcgatatattccttcacttctgaagccatttcctctggagtctggtcatactgtcccaaactgttgggaagtccggcattgggataagcacttatataataaggtgcgcgtgcggccagcccttccaaaaaaggtttcaattgtttcgctccgaatgagcagttcagaccgatagaaaaaataggcgcgtgctgtacggatgccaaaaaagcatccaatgtttgccccgaaagagtacgtcctgcaatatccgaaacagtaacagaaagcataagaggaacctcgcgccctgtcttcttcattgccgtttccgcagcataaatggccgctttggcattcagggagtcgaaaatggtttctatcagaagcgcatccacccctccttccagcagggcctccatttgttcctgataggcggtggccagttcatcgtatgtcaaagcacgcaaggccggattattgacatccggactcatggaacaagtcttgttagtaggacctaccgaacctgctacaaatctaggtttacgaggggtcttcgcggtatattcatcggccagttcgcgagcaagtctggcagcggccagattaatctcacgacacaaatcctgcatatgatagtctgccatcgaaatccgttgggcattgaacgtatttgtttcaataatatcagctcccgcttccaggtatttgcggtgaatgtcctttatcacatctggacgggtaaggcaaagcaaatcattattacctttcatttgtccgggtatctcggcaaaacgctctccgcgaaaatcctgttcggacaggttgtaccgttgtatcatggttcccatcgcaccgtcaaggatgaggacccgctcgttgattatttgttttaatgtagccataggtctattttttaggcacgaattacacggacaacacggatttcctctgtggttgctacaaccgggaaccgtgaaattcatgtaatccgtgcctaattattataaaatatttatcttttaaacatacggtccatttcgcgacggtcgtctttttctttcaacgactcgcgcttatcatattgttttttaccttttgccaatgcgacaaccaactttgccagtcctttttcattaataaacagacggacaggaacaatcgtaaaaccgggattctttccggcttcttccaattttcgcagttctttcttgctcaacaataatttgcgttctcgacgggcggagtggttattatatgaaccatagaagtactcggcaatgtgcatattcttcacccacaactcgccttgcacaaaataacaataggtatctaccaagctggctttgcccaaacggatggattttatctcagttcccgtgagcacgatacctgccgtgtacgtatcgataaattcataatcgaacgatgcacgcttattctttatattaacaggagtcggtttcattaattcaaaataacagataactcattaaacacagcggcaatcaatgccggacaaacaattataataactgaagcaatcaaggtgtatcgtgtcagtttctcttcatttaccttcatcagggtacgtgcaccttcgaacaccacaaatacggtgtaaaattgcaatatccaatgaaggatggaaatagaaaacaacccgctgacaatatcgagcacaaaagtcactaccatagaataacctacaaactgctgatttagttcatactggtcttcacgccctaaaagtttcttgcccaattggtctatggcgtatgccgccaaaaaatatcctccaaacaaggatacaaatatagcacaacatcgtgtcatcgctatttggaaagcagcgactccttccgtatttcctatgaatgtacctataaaaacggataaaccacataagcctatcatgggataaacaaatgctcccaacactttacgcctatcctcttctctgctaatttcctcccacacttttgccggagacgaaatcaacgctattactcgcttaaataaatctttgtagttcaatgcctaatctatttacctctgttcaacttcaatgaaatgcaaaggtaattaattcactggaataaacgaataaaaaacgcatacttctcttgggggaatcaaaaaataagagtacttttattataaatttagaagaaggacaaatataactaaggcaaaatgacaaaagaaaaaactttgaaagctttagaatataaaaaaactaaatgttaatttaaaagaaggatgtctgggaattttctctccatagggaatgcatagctttataatcaggttcatccttaaaagatcttatccatacctctaaacctttcttgccgtatggttaagggttttcttcctgcctgttttatctccgcaagcctttggagttaactccatagtcttgggagataactccaaaacttatggagataactccaaaggctatggagatagaatacatccgcataaaaaggtttaatcaagagatagaaaatgtttatgcaacaggaacgaatgcgatatgttgttattacggcagcagaaagatcgaaccgtttaaaaattcatgttaactcttttcacatgcaggaggtatatactgaatctaaagaaagatatgaacaggaaaataagaagtagtccccgtcaaatttctatcccccttatcttatgaattgaaccatatagttccattaaataaaaaatccccttcaaccgtagctgaagaggattttactatataataaaatatcattaatagcttgcttgcatattcgaagcactacatttcactgtagaaacaagttctttatcattttctccctttgccgtcaccttaactacaatagtatcactcttaggcactacttgatcgaaaatatcacgaaatttcatatcattaaaaggcatatggaaactaatcaaagcactccctgtctgataagcatcatcagctcctttggtctgttgaagttttgtcaccaatgtatcctctttggcttctacagcatataaatggaaatcgttcatactcagctgttctttagttttaaaagtaaaaggtacgttaacatatccatttatggcccatatcttattattagaatcttccaatgacactagtgcataatcagttctcaatgtatcagactgaacattaaaatctttataattcaaaatagccaatacgccaacttcacttaccttataagactttttcccttctgtaattgcttctccttccatcaatttgatccctacctgcgcacgcttgtaataactgccgtcagatgccttaagaccagccaatacacttgaagccactggagtataagtatatccccatgcatctcctttcagaacggttccaccaaaaatactaccttcttccacagtaacgatctcataaagatcataattggagccgctatcaccatcattcaaacaagaactaaaagtaaacaccgatactaacccagcaaatattgctgccaatttcatttttttcattttcttctttataattattagggtttgcaaaattaaataaaagaaccggtttccaagaaagaaacttaattctttttattgttttaatgattaaatgaaaaattggcttaaatactgcgtcgtcacttactttttaacattattttttattcatatctcattctctgataagacttgctttatcttttgttttagctattttttccactgagattcacttgtactctatctgccattaacccattaataaaaattaatacataaaagaacaagcagtttagctatagtaccactttatttcctatctttgaaacaaaacacccattaaccataaaatctagaatattatgctaatactcaagaaatcatgtaaagcattgatcaccgccctatgtacattgtttatatactcttgcagcagcaatgataaactggatatcaacaattatcagttgcaatccattcaatggaaacttagtgcaaatgatgccgagaaagtcgatacaattgagttgcctcctaaaataaccagcaacaatacagaagaacctatgtctatcactttttcatttgaaaaaaacataaaagagacatcacaattttacagtgacgacccggaactattcaattctttgactttaaaagagaatatattggttgatattacagctaatgccagtaccttgagttctgaatatagaaaattatcatccgacttacatgcacctctatcccttaacgaaacagtgctttcccctctatataaatcaaaagaaacactaaaactttctccacatacaaaagtaacgactgaatgtaaaatatatatcaaagaatatacagcaacctatttggctatttttgcaaatgacaaaggagaaactatagagatgagtggcaaatggaaaggagcattcaataaaggttccaaggttacttatattcttaaagatataaaatgaaacatttgaatttaatatagggtaatgaagtggactacagcataaccaatcctcatctaccctatatttttcaagaacatttttttaaatcagcctatgactaaaagaatcggcataaatatatagttaaatatgtaatctacatgatacctgtatattatttttgccgataagataaatttccattcctaccgattcggtaaaataaactatttatgaacactgtattcttcaacgaatacatccaaacaagccctaaatttatgaccgatttcaccccgtggacactctttgtcgatacaggcatcatctcagtattgctactgctcggcaaactcatgagagtaaaaataagattcatccaaaagctgttcattccccccagtctgttggccgggtttatgggactggccttgggacctcacggtttcggcatcattcctctttccacccaaacaggaacttatgccggcatattgatagccttcattttcggtgccctccccctcacctcacaaaaggcagctaaaggagatgcagacaatataggcagcatgtgggcatattcacaggcaggaatgttgttgcaatgggcttttgggggactgttgggattgcttgtcttaaaccggatatggcccttgaaccctgccttcggcatcactatgccaagcggctattgcggcgggcacggtacagcagcagccatcggacaggctttcagccagttcggatatgacgaaattctaactttggccatgactgccgccaccttcggtatcgtagcagcagtcattatcggattgatcattataaaatgggggacaaagaaagggcacacctccttcctcgccaattacgatgaccttcctcacgaattacagacaggcctgttgcccggcgacaaacgggaaagcatgggtgaaagttcttgctcttccatctccattgacccgctgaccttcaatcttatcattgtagcagtgatagcattaggcggatactgcatcagcaaaacagtatcccactttatgccggggtttgaactgccggtattcagttgcgcatttgtggtgggtatgttcatcaaaaagatattcgacaaaacaaagaccagtgattatgtctgcccgcaaaccataggacacatcagcggaacttttaccgattttctggtagcttttggaattgcttccattaaaatatctgttgtaatagagtacatcatacccttattaattctgttagtctcaggattaattgcaaccctgatttatgttctggtcatggctcgcaaattaatgaaagactgttggttcgagaaagctatcttcacatggggatggtttacaggaactatggctatgggcatcgcattgctccgcgttgcagaccccaaaatgcgcagccgatgcctggataactatgcactggcttacttgttcatcgccccggtagagatttccctgataactttcgctccggtagctttcttgaacggttacgggctgatgtttacaggaatctgcctagcggcaggacttgccgtgctggcaaccgcttatatcaaaggctggtctatcaagaaacaataaatgacacaggaataacaaaacagaaaaaagtaagttaacttacttgaccaaataacataggttcgtcagccaacgaactatcttacttagccattgaagccaatttacttttttatatcaaaactcatgagtctataccaggcaaacgtacgcaaaagtccttgtcatacaatctccgcaaactcctcaatatgattgtccacatattctgcaatccggacagttaccaactcttccatatccatgaactgctcttccaactcatcaaaggcctcgtattgctcatacattgccataaattcctcatcatccctgtccttttccaaatcagcacggttctcatcatatattttcttcgcgctataaatcaatttggcaaattctttcgctccaaactgccgcattgcttttgcaaaaggattatcaaagatataaggtccaaaaccattctgtatcaattgcacaaaaccaccttcatttatttcttcacgcaagaaatgataccccaacaatgaatgctggtaaccattgagcaaaggcattgtttccgcattgacaacacctcctgtcacctctaggtatttatctataaacaccttcaaaaaaccatccataccctcttccgcacctcggcgcaaagcttcgtctgtaattgctattttatttgcttccattcctatcattgtaatataggtacaaagatagaggtttcatcggaaagaaaaaacattttggcaactctagtttgcaaaatactgtcctacaataaatttattttatttaaagataaaaagtgacgggcaacaagttgcagaaaagaataaaacgactaactttgtgggcgaaaagaataaccaatcttttcacgtggtttacgaatatttattttattaccaaaaaacgtaaagaatatgacttattcacacgaagtagaacacatgtgtgttgtgaaaaaaggtcctaatcacggaccagctcctattcctgaagaaggaaagtgggtaaaatcaaaagaaattaaagacatctctggtttgacacacggtattggctggtgtgctcctcagcagggtgcttgtaaactaacccttaacgtaaaagaaggcatcatccaggaagcattggtagaaactatcggttgctccggtatgactcactcagccgctatggctgctgaaattcttccgggtaagactgtattggaagcattaaacactgacttggtttgtgatgctatcaacacagcaatgcgcgaactattccttcaaatcgtttacggacgtactcagtcagccttctcagaaggcggtctgattatcggtgccggtttggaagacttgggtaaaggtcttcgcagccaggtaggtactttgtatggtactttggctaaaggtccccgttaccttgaaatggctgaaggttacatcaaaaacgtattcctggataagaacgacgaaatctgcggttacgaattcgttcacatgggtaagttcatggacgaaatcaagaagggtactgatgctaatgaagcattgaagaaagttacaggtacttatggacgtgtaactgaagaacaaggagctgttaagaaaattgatccacgtcacgaataattataaggaggaaagaatatgattagagaagtaaaattcgaaagccaagaccgtcgtatcaaacagatcattgctgctttgaacgaaaacggcatcaaagacatcgaagaagctaacgcaatctgcgaagctgccggacttgatccttataaaacttgtgaagaaactcagcctatctgtttcgaaaatgccaagtgggcttacgtagtaggttctgccattgcattgaagaaaggttgcaaaaacgctgctgaagctgccgaagctatcggtatcggtctgcaggcattctgcattccgggttctgtagccgacgaccgtaaagtaggtatcggtcacggtaacctggctgctatgttgctgcgcgaagaaactaaatgtttcgcattcctggcaggtcacgaatcattcgctgctgccgaaggtgctatcaaaatcgctgcaaaagcagacaaagtacgtaaagaacctctgcgttgcatcttgaacggtttgggcaaagacgctgcacagatcatctctcgtatcaacggatttacatacgttcagactgaattcgattatttcacaggtgaactgaaagtagttcgtgaaatcgcttattctgacggtcctcgtgcaaaagtgaaatgctacggagctgatgatgttcgcgaaggtgtagctatcatgtggaaagaaggtgtagacgtatcaatcaccggtaactctactaacccgactcgtttccaacatccggttgcaggtacttacaagaaagaacgtgttcttgcaggtaagccttatttctcagttgcatcaggtggtggtacaggtcgtactcttcacccggataacatggctgccggtcctgcttcttacggtatgacggacactatgggtcgtatgcactcagacgctcagttcgctggttcttcatctgttcccgctcacgtggaaatgatgggattcctgggtatcggtaacaacccgatggtaggatgtacagtggcttgtgctgtagacgttgctactgctttgagcaagtaatataatacattgccaatatataaatccctataaccattgcagttatagggatttttatttccagtaatttcattcgtttaactgatgacccaccccctcctatttttcaatatcaatcaaaagtattgcaaataattgtctaaaattacggaatgaaattggttctttaaatcataaatcggttatacaattaagagttggtttaggataaaaggaggtcaaaacgaagattatttatatgcaatctggcatttttgaaaatttaaaaacaagcaaaattcaacaacctgttttatcctgcatatactcaaagaacgattatcataatataaaattgacgagcaagaaaaactagatcaaatccctgtatcttaaatattatcaaaaaaaggaaggctgttttcacgccctcctgtctgtccgcacaattatataatcccgtatttgcagtatctcacagaaggtagagttagctgatgcctaacatgatagcccctttacctagttgttttcggtctgttcgaactaatatacattttaatatcagacttcccctgccaaattcacatcaaaaacgaggttttacaaatttgtcatctggagatgtaaaagacaaccccggaacagaacggcggatatctttataggcatgttctttaatcagtgaataatctgtagcatccaaagcatagtaataatcatctttatctgtcgataactttacagtccagtcaaacatatttccaaagatggtcaactcatcttttgccggatcgaaaccggggagagctgatttcaccaaacttccatcactattgataatataaaaatgatgcttgctatctaccatataccccaaagtccgacggctacggaattcagtaataaacacatattccggcaagactccttcaggcaactgaatagctttcacatacggacgtcctttggtgcacttcagatggaacaatttatggttggcatctaaaaccagatatccctcatcatagtctttacgagtagttggattgcccgaagcatagcatgcaggaaaagcaaaccctttctgaaccagcatatccgtaaacaatttgcttttcgcctcatcgatacaattcgtctccatacgaataaattctatacctttatcggtaaaacggaatgcatcttcgggcattttcaaatccacccgtttggacatggactccatcagaaaatagagtcctgtctgggaagcattgatggctgacggcacactcttgaaagtaaagtttgtcaattgaatatctttcggactaactgccttaccacaaatggtatcagggaaacgttcgtccgccgtaagctggcgcacatagagagaaggcaacaaactgtctacctgctgttgtgtatatgtattgcctttcgtatcatagcggtgaagttgcttattctcatctagttgtgtaataacaaaatcaccaagtacggaactatacatagtaaaaggagttttgacaggcttcagtgtgagaaaagcataacaccaaggcaactgccatacaagcaggacagctacggtaatataaaaaaatattttgctgaatcgaatcatgtttgtttgattttttaataataaacattcaattagtcttgcttaccggccttgaaccgtaccacagaaatccacgaaagagaagcggcaagcaacgtataaagtgtcagacagagcaagaaactattatatgcctctgctcccggagccagaaagtagacacggaaaatcaatgccgcaataatcagattcaaaaccctgcgcttccatgtgggttccaggcaaatccatgaaacaagcagataaccggcaaatccggcaagaaaccatggagccgcagataataaaacacgctgcaccaactcacttgtaaaatgttgtggcagataaactcccatcataataaaactcatagcaaaacaggtcaccagtgcaagtacgccataggccaacattgacatgaccattttcttctgtgaataaggcaaatgcaaagtaagcttcaaacacttacgttgcatctcggggaaaaactgtacggcagcaagcaagataccgataagtaaagggacaaattgcaacaaatcaataaatatagcatccttctggaccatcactacccataaatgatcgattccctgtatggcaatggtacggccaatacgaagcatggaatatcctgtgatccctatcataaaaagagttgccagcaaccaataccaacgcgtttttatccactctttataaaatatggcttgtatcatatttcttctatttagtttacatattaatactttccggtaagaccgataaaggcatcttccagacttacattttcgtgctgcaaaccagtaaagggaacttgactttccttcaacagtttctccacatccacgggaggcaaaaaggagtacgtttccaaggtttgacgaatgacagccggatgatagcaagttgccggcaactgaggctgataaccctcgggcacagtacaagtatatcttctcagctctttcatcaacgtttcaataggctgttgaataaggatagagccataatccataataatacaatcatcaatcaaccgctccatatcctgaataatatgggaagtcaggaaaacagtcttgttctcggaacgggcataatcacgtaaataatccacaaaaagacggcgatagcccggatcaagtcctaaagagaaatcatccagaatcaacaactccggattttgtgccaggatcagtcccaatgccacttgcgaacgctgtccgttcgacattcttgagatacgttgtcccggagctaccttcaatttattcatcaagtcataataagcctcctttttccattgtcccggataaaaagaagcataaaacttttctatttgtgtgatattcataaactgatattgaacatgaccttccagcaataaaccgatattcctgcgtaaagcagggttcatggtctgaatgttctcaccaaagatgcgacattcgcctgaacgcggctgaagataaccgctcaatatattaatggttgtcgttttccctgtaccatttttacccaacaaccccaagatacgcccttgaggaacttcaaaactcaagttctcataaatcttgcgttgaccgtaataatgggtcaggttcttacattctataattgcactcatgctttataaatcatttttcgtttgctattagaaacacgccaggaaaagaataggaatcaagataccggccaccaactcgattcctcctctgccccacaatcctttaggaccttttatcatcactataccgctgacagtgataataatcagacagacagcaaaagcatcggcaaaccaagtccaccacttacccggattgaaatggagttgtaccatggaagagatcagcggacggcgcttcaccccctcgtagacagcatcttttgtccgggtgttaatcaccagacttgagcctcctttcagaaaaaccttaatcagatccggctccgggtaataatatttagtaaaatttccggcttcgcccagcggttccaacaaagtcaaaatcatcttctcattaactttgctcttgtccgacagatcctctgttattttatattccgttcgtgtaactgtataatggggatttatgctatccctatggttcatcacgatacccgaaatagcataaatcaaaatcattcccgcaaagaagaaagacagatcacgatggatgatccggctccacttgcggaatgcagtacctttattctgcgatttcataagaactggcttccatatagtagaatgacagataatcttttccggtagcagcttttctttctgctatctttgcgcgaaagtccgcaatacgggcttcaggggtgctggctgtttcaccgcgtgcttttttttccgaatcacacccggcagcagtttctccatgagatttttcagtctgtgctttcagtttagcctcccagttttgcaagtaagcttcatctacccgctgttcctttaacgttccggtcactgtgacaatagcgttgatgcatttggtatcaaacgagcccaaaggtccggcttccacacgaatcgttttggtatcatcactgcccatcaggaatatttttgtagctccgtgcttgcaggtatgtgtgcagattccttcgatagtcacctccttgttggccagtgaatcggcatgcaccagcagattatcgatactcaatgccgccggagccgcctgctccgttttttcagactggctctgtttgttactgtttccacaagaagtagtagttactaaagctgccattaaggttgcagcgaccataaacttaattttcatatgctaactgtttttattttttaaaaaaagatgcccaatgaacaaacggcatactgggccgttccgcattttttataatatgccgcctgccattgaacagacaaagacaggttatattgtttcatgatgggataatccccttgcagacgaatccccaccatactataactatcagataaatagtcaatatttgccaataaagtctgggcggacgacttcgcggcattcaatcccggtaaagaatattcagccgataaattggcataatatccaccgttagcttctgcggtcaatcgtagcagcctcttctgatacagcaaacgggcacgcaaagaactctccaaaacagacaagtgaacaaaccgggatacggcgttgtaatccgtttccaaccgatggtagattatgtttgggacaattgctcctccccatacacctttatcggtcaaaagcttctcccacaaaccacttacggcaatccgactattcgtgaccttcattcccggagatgtactaattaatgctccataggagcttccgcccgcctctccgtaaatattctccattcctttacgaactatatagcctgcatccagtttcacagcaaggtgttctgcctgctgaagttcccgcatccaggtcacgtttcctttcaaatcagtcgtattcaattccagcaaagtgagattattggcattgctcaatttcttgtccattgacatacggtcaattgaaactgtggccgatatccccttttccgtatcaactggcagaatgcctatgcttcctccccaccggatgccttgatgcttcgtcccggtctggtttccggcgaaacgcacataatccatgcccaatcccaacatatggtataccgaagtagagcctttatctgcaaggaatgaaatctcacttttctgctgataaagccggaaatctgcggaaactcccaaacgatatgtccccagacgatatcctgttcccaaagcaaaagagagatcggaagctgtattacgtggacgcggatctttatcccgataattatgagacgctctgtaaccaccggtgattccccatgtccaggaacctgactcactggcgtaacctccattgaaataataagtttctcccttcaggaaaccaccaatggaatcaccagtcacgtaaggagctatcaatttccagtctatattttcattccataacacattctcctgcttctcactcctgtatcctgctgaaccgaatacacgatcacgttccgaaagaataacgaaggaattgacatctaccccgatacgggtatccttatcaccttcctgtttcaaagatgcttttcctttatcatgataagctccatttacgtccagccttgtccatgtatacggagtatagtaataataaagtgccggattctgccatatctcgccacgaaatccggtcgcaaatgaagcggtacggattaccttatcggacagggagagtgtgtcggtagtctgcccgaaggcttcctgccgactctccacaaataaagcaatcagcaacataatgataattcggattagcatcatgaataataaagatttatatatcaataagacggattcaattatttgttaaacaggctcggagtagccacaggtgtgaaatcaacggtagagttatttgtatcctgcaatacttcccgatcaccatccttgtaggcggctttacgcattacgcactttccgatgttttctgcaacggtattgttcataccgatataagtatgccccatatccagcccggtagaggttacattccactgccattcattggaagcacctacatttacagcatcaatcacccattcattggggaacttatatttgctttgcggtttactggctgttccattttgcataatatacgtatagttgtatgcatagtctgaaatatacttttctttagtcatacttttgggtaatctgccaatagcataagcgcgatttccctgtttattcaacacccagatagttttggaataacaataataaacatccagattgggaacagccggattatccacatcttgctttgattcaatataccactcaaaattggctttacttaaatctatagaattcggattagcctctttatgattgatcgcattgtcacaaaggataaaggattctcccggttgtaccggataatctgttccactgcccggtactgctacaacagagcctaccgcaatagcttcatccatgatatccggatctaccgattgatatttctgagtagtttggaattgtgattccataaatatcaatccatccgcatacaaaactttatccgagttattatagatacgtatatactggtcgccattatattgcttacctgcttcattataggttccgggaataaatatctcggcaatcacaaaatcagggtcacctgtattgagtacatgaaccttcagttccagcttgtacgaccctccagatacggccacattctgttgtactccctgtacatcgacttccaccggagttccattctgtgagtaagttcccttaccaatgaaagttacattatacaacccgtccgccagttcaatactctgagccggataggtaatgtctgtcttgacagatgtatttacattttcaaaagtataggttccaccggtcagttgcagcccctcgatagttgtatctacagtagtggtaatacctacagtggatatgctcactttgtcatcatcactacatgcggtaaatcccagcattgtcgcaaaaaggactaacattgtcaattgattctttttcatcttcatctctattttattgttcatttactaaaaagttaagttcatttccataccgaaataaggcgattcggacgttctccgttgcagtacgccccgtaacgtataatcaggataaatacccaaaagccggtttacataaaaagccagattcagatacttaccgatccgtttactcgccttcaaattgatatccatataaaaaggcacggtagtacgctcaaaataagtggctgaatatttctccaccagatgctgtaactgaatattgtttttatcctcttcgcgaaacggatgcgtttcaccggattgatctatatagcttaccggcacgccattattccacaagttccgtctgttggtataccaagtgcattgtgccgacgtagagaaagtaagtcccaaacgctgtatataggtatcaaacataaagttcgtattgaatgcctggctttctgttccgttgtccccattgtacaatcccacatatttcagctgtttattgtccaacaatatagaagaggccttatattgaggagaatccgaattataaattgtctttatccaggctccatacatagtgacgcgagtcttgagcgattctattcgtttggaagcgaactgaaactccactccttctttacacaccttcattacattaccttgtgtggaatacacatccagattatattcatttgtataagtcaactgagaaagttctggaggagccgtcaatgctgatccgtcgatactagcaggatcatatagtttatatgccaatgacctataataagtgatatcatcaaaagcattattcatccgttcgcggaaataagttatcgacaggcggtttcccttatagctgacgtcggcccgcacttcccatttcatgttacgtgctggttccaattgatagtttgtattatcccatttatatgtcatcatattgatacggcgataatccggattggtatggtaataattcaactgaatcaaatctacatacttaaaatccggatatagctgtgcggtggtcggcatacggctgatccagcccaaacctcccgaaaaggcaacatcccatccgtttgataccggtaaactccattgcaagtccagacgaagatcgggatatatcttgccctgcatcttatatttagtgtccagccccaataaagactgcaaacggataccagccgtaaaagccaatttatgtctatttacaggaagattcaacacctcctcggcatagaaggcgaaaggttgcagccccggtatatccttaaaacggcgaggccgtgtactcaaactttcactgatgggccgtgtcacatcgaatacctggccttctcccaaattcttctgataattccattccatccccatattcatcgcattctgtaatacccccaacgggaaagccaaccgcgtacgggcggaagccgtaacatataaaggtttaccatcaatatccatctgtgccacataattataaggtagatagatgccatcaaactctccggtttctgtctgagtagcaatagctgccggacgattcagagaaacggactttatttcacgcatcttctcccactgctgactgacagaagtagtcacaccaacctcacgaatccataaatgggccggaaacttcatgctccatttccccgctatcttcaggctgttaaagtccgatttataagaatcttcctttactgtcgcatctttatccctcttcgcatcatcaaacgagccggtataatcggaactgatattccaatgaatattacgttcattccataaccatttgccatccaagcgggcggaagcagtaaggcgagtgtaatttttcacactgttacgcggatctattttggactccaaatagtttaaatcagcattcaacacataacgcccgttcccatccagccgaattcccttgcctacagaaaacagtttactggttttatcagccttaaaacgcgcagacaaggggctctcattcattttacgctgaatgattaccgcaccgtttgccacattaccataagccacggaaggaatgccacgaatgatttccaccttctcaatattatcggttgagatggtacgcatatccatcccttttgacattgtgctcgttgcattcactgcggaagtactgtttggcatatattgcagattcgcatccgtattctgggagataccatcaatataaaatccaactcccaatgaagagatatcctccgtcttacctgtttcacgtatccggatcagattggcctgccccatctgaggatcagccgactttcctccaggtactaattccatcaagtcactgaaactgctgggctgaagatgtttcatggctgtacggtcaacgatagaagcgctggtagcgcgttttgattcagaagcggtcaccactacctcgttcagcgccatgaccgaaggttttaaataaaagattgctgaaatatccccaatgaccttcacttctttttctgtagaatcatatcctaaataggatacaataacccgataagttccaggatggatatgtagaagttcaaaatgtccattcgcatctgttattcccccataaacaatctgcttatccacaaacaattgaactgtagcgtaatccaacgctttatgagtctgctcatccagtacagttccccgaaatacaaatgtctgcccccataaaagagacacattgctacaaattataaataaaaaaatatatgtaatcttacaaatcatttcattctctattggtttgcaaaattacaattcataaaagctcggcacaatccccatttctaggtatatactaaattatacatagatcggagatacctacatgacggtatacaatttacaaataaaatcactttcacctaaactttatattcacattttttttcaatgataagataaatacatctactttttacctgtttcaatggggaaaatgccacgccatataaatacagttcattatcaacatattaccccataagcaatggtatgaaagcataatggcatacaactttatattacaaatccattggcagaatatttatatccggcagtcaaggcacatcaggtttattaagtaatatctatccttcaaatattaaattagcaagtgaagaaaagcaactgcaaaaaacactatatttgtggaaatgaattcaaattaaacagttagattatgggaactttaggttgtatcaatgacatgatgagaagagataaagaaaatcgtgaactacgaaaagcaggaaaggaacgcttaaatgaaattcgaaaccgactggttgatttgaacaaaaaagagcactcctcccatctatcccttgagcaattagaagagatcagaataaaaacgcaagaaaaagaagaagcggaaactaaccagctcttcaaaataaaattaatcatgttaggaatcgttctgatatcaggagctctggtatggatagggattaccttctttttttaaaattctactctctattttcttccttattccttgaaaaaaccaataagaattcttatatttgtgataccaacttggaataaccttaaaaacagatagatatgaaaagaatattattactactggttttatgtttaaacataagtatggtgcttggacaagagtataaaaattgggataaatatgatatagagggattctatacgattgccaaatcaaaagcagaagccaagattagcaaaaatgtattgagggaaggagcagattattatattcctaccgaaatggatgaccaagtattcccaagcggaatcagtaaaaagatcactcccaagctgtacaaactaaaagacaccgagatttatgtcttttttacttttccaccattcctgtatgattcagacaacggaatgatagaaataaaaaacaataaaggagttttttataaaagtccgacaaatccttaaaaatgatttaaacgagaaatatcatatttgttttgaggcatggaacaatgatctgataacaatcttaatctggtttgttactacccgaccgctcttccgcaaaacacttctttcggatagagaatacattattttcacaacgttaaaatattctgcaaaataatattttttctcatctgttcatatttaagtcctattaagaaaagttgaaaagagaatagtaattcatattctcttttcaattgtgtaatcaaatagaattcctcataaattccatccagaagtactttcctgaattttccatagccgggcataaagaccatctacccgaatcaattcatcatgtgttccttgttccttaacttgaccatcgtccaaaacaattatccgattagcattcatgattgtcttgagcttatgagcgatagttataacagtacgacctttgatgagagtatcgatggccttctgcatttccacttcattttcagggtcaagcgaggcagttgcttcgtccaatagaatgacttgtgcgtctttcagaacagcacgagcaatggatatacgctgtttttctcctccggataaagtacaaccgccttcacctatcatcgtgtcatagccttgcggcaactgcatgataaaatcatggcaacaagctttttgggctgcgacaataatttcatcatccgttgcaccagccttaccaaaacgtatgttgttgcgtaccgtatcttgaaacagatagacatcctggaataccatagagatatgactcatcaaactttccggatttattttatccatcgggagatcaccaaaaaaaacacgtcctttctgtgggtcataaaaacgggcgcaaagtttcattactgtactttttccacttccggaaggaccgacaagggcagtcaatgagtttttggaaagcgtaattgaaacatcatgcaggacttccttgtcccggtaggcaaatgaaacatgttcaaaacatatatcacctgtaaccggagattgcagttctcctctcatttccggctcatccatcagtgttaaaatacgccctccagcaatggagaaataacgaaactcggcaaagttggtcaaggcagaagttaacgggtcaaacacacgagatcctactacaagaaacagtataaaaataggcaacgagagatctccactcaatagcaaataagtaccgcacagtaccatcaatgtcagcccggcacgcaccaaagcaatggaaagcagcacaaacgggcctaactgtgcctcctgacggatacaggcacggcgcagttctgcaaacgcatcacgcaaccggtcaaaatgggctcccaacaaattgtaagctttcaccacccggataccttgcagatattcttcaaatcggcttccagcattaattttggcctgaacctgacttccactcaattttttctgcacactcgtacttacccacaaaatgaataaagccagtggtaaagcggcaaacatagcaacagccatccgccaatctatccatattagtgaagcaaaagctagtacaggcataactacagcccccatcagttgaggcaaatgatgggatattccggtttctgccattgaaaaatcggtaataagcatagacgacaagtcaccgggatcacgttgtgaaagaaatcctaacgagagcttccgcaagtgttctgccaaagaaagacgtcccgaagcactcatctcatatgcccctctaaaattggaacgataggaagctcgttccgctaacgccatgactatcatataacaagccatcactccgaatatataccacaaacgaaccgtgtcaagtggccggccacttccatcgaacgtattaaaaacaatacgtaccgcctcaatagagaggcaaaacggcacaatattaatcaaattggcaagcactgttaaacctactggtctacaaagacgtttcgtatgaccaattgtaatgtttttgatcgcattcatacctgttcctttcatttacgtgcgataatatacatttcttctttattatgaacaacctgaatggttgaaaatccggcctctatcaacaaatccttcaaatctccggctgtatataccaccattccttttatccgttcagtccacatttttccgagttcaggactgcttgcttccaagccgacaaggaagcatcctccttttcgtaagactcgtaccacctcagccaacgctatctctatgggcgaccaaaaatagactgtttcaaaagcagtaacagcatcaaatgtcccgtctttgtatggcaaggagcacacacttccttgctgtatgaaacatcgtttattcaattctttcacattgtatttgcttgcaaaaactacactctcttccgataaatctataccataaacctttccttgaggacattgtttcaacaaacgattcaggttggctccacctccgcatccaatatctaggacagtccattgcggttgccagtttacctgtttcataccacgacgggccaaagaagcatgaaaacgattcattccccataaaatcatccgaccccaaaaacctttcggacagcttgtattctgcaaaatactgtttaataaatgcttgtttctcatatcaatatatgtttaattcttgtttaacgaccaatggtaagcgtttctataagcatcccacatacttttatataccccctctttcacagataaaatattatgttttccacattgcacaatccggccttctttcatgacaacaatctgatgagctgatacaatagaagacaaacggtgagctattacaataaccgtcttgtcttttatcaaagactgcaaggccatttgcatcttatactcgttttccggatcagcaaaagcagtggcttcgtccagtactagtatcggcgcattcttcaagatggcgcgtgccacgcatatccgttgcgcctcaccgcccgaaagaaatatacctttatccccaattttagtatcataaccatctggcaaccgttctatgaaatcatggcattgggcggcttcagcagcagctatcaccacttctttaccggcagaaggagaaccgatggcaatgttttcatacagcgtatcataaaacaagaaagtgtcttgaaagacaaacgatacggtatccatcaactctgctgttgctatttgcttgatattcacaccaccgataaggatttcgccctgctctacatcccaaaaacgcggtatcaagttggctaccgtcgatttaccgctaccagatggtcctacgagcgcagttatttccccttgctgtgccttgaaattgatatcatgcaaaactttcgtccgtgttccctgttctgtgttctcataaaaaaatgacacatgacgaaattctatatcatacctctccggcacttgtggatgttccggctcgggaataggttgcctctccagtatgcggtcaatacgtgctaccccctcattgatttcccgtgtgttcccacccaagaaagtcagtttgtaaataggtgaagccacacctggtcccataataataaaaaacaaccataccgcagccagtgacaaagattgcgggttggcattcagcaacaggatacccattggaagaatgaatgtcaccattgaaccaagcagaacagtaaaggcaatcatcccgttctggtaggtatcacagcatttcaaagcaaatgtcttgtatgcctgtatctctgcattgaactggcggaacgagtatacactttgcccaaaaatctttactataggcattccacgaacatattgtacagcagaagtactcatcctttcctgtgcatcgtaatagacacgcataaactccttcgctttctttcccataaaattggaaaattgcaggaaaaggcttaatacgacaactgtcaaacacgccactgtcaaccatacatttaatgagaagaaaatgacaaacatcactgccaccgtagctatcacatttaccaaatcggggatagtatgtgcaatgaatccctctatcttctcgatgttctgatccatcgttttcttgatggacccgatggaagtgttgttcagatagcccaacggaagtttaccgatatgttcggataaacggacacgcaacccatacaagattcggaatgcggctacatgagaggacataagggcagcgtacagcaaaaccaatccgccgacaagtccacccagtgcgatccatccccaacgtatcatttcagttccatttgccaaaacaggattgctgccatgcaacaacaactctttcagcacctcatagacagcccaatagggcacaagcatacacatggcactacctaccgacaacaaacctgccagcagaagcaaccctttcttctgtcccgcaatctctaacaaacgggacaatccttctttcttctttttcatataattgtactatatcaaacggattattagtgaacggtattcaaatttgttcataaaaaaaggaggaaacctccgtaaagacttcctcctttcctgctgccttactgtagcaaccagtctgtatatacaaattttacctgtcatattcgaataatggccctccaaccttggatctcaaatagaatataattgtgtaaaatagctttcatttcctgtttcgctattgaatgcctcaaaagctcctcaaacatagtaaacatccatacagtatgcaaatggattataaaatcgggaatagctatatttatcatcgggtactttctctgcatcaccgtaaaccagactttgactaattcggttgaacggtctgtataattctcccgaaaacattccaatgaagaaccttgcgcacgaaataacagtattttcatcaatctgtggtgggtgtcatacaaggaaatatattcgtttatacaggtttctaagtattcttccgacctcatcatcataatatcctcgccctgtattccatgatgttcctgcaacagcatttccaacgcatacaaaaccggacgaacaacttcatgaaacagctcatccttacttttaaagtagttgtaaatatttcccaccccaacacctacatccacagctatctcacgcatggaagtcttggaataacctttcaactcaaattgttgtttggctacatccaaaatacggctacgtatgttatcctttaatatttgcatgtatagtcagttgtgattctgtttttatgatggcaaaggtaatgagcttatcattatctgacaatacctatttttagggattttaccctctctaaaaactacaaacaggtttctatagcctcagccaaatcttcataacttgccaacgggttatccgtgaaaacactacggataaccaactctttatctatgacataaacacgaggtatccccgatttagcaaactgatagtataccgtgcggttttcttgggccgaatagggcaaagtcaaatgattttcgtcccaataacggacaatctctgccgaactctcttccctgctaatacaaaccatccggattctttgaccgtaatccgtatatattttttgcagcacaggaagttctttccggcagtccggacaacccgtatgaaaaaacacaatcaaggaaacctctcctttcagggtttcggaagttattatttgtccatcatccattaccacagaaaaaacaggaatgttctctcctgtttgtaaatcaacagtaccttcctccacatcatcatcaatacacgctataaacattacacaggtccaaaacagaaaacagaccgtttttatacaattcttcattttcatttctatttttcttctttacaaagataacatgattttcatgaaattactacttttgcagcatgaaacaagaattaaaagaaaaccaaggactacctgcctccttactttggacgctagcaattattgcgggaatctccgttgccaatttatattataaccaacctttattaaatcgcatcagccgtgatctccaaacatccgaattcaccgccaacctgatagcaatgattacccaaataggttatgccatcggattgctgttcattattcctttgggagatttatttaaaaggaaaaccattattctaatcaatttcacagtcctagtcgtttcattactaaccatcgcactgactccttatatccatctcattttatttgcctctctgctgaccggcatttgttcggtgatgccacaaatctttatccccatagctgcacaattctccacccccaaaaccaaaggaagaaatgtaggcatgattgtatcagggttactgactggtattttggcttcgcgcgtagtcagcggaatcgtcggcgaatatttgggatggcggtttattttctttgtagcggcgggaatgatggtgatatgtctcatcattatcatgcgtgtactacccgatatgccatgtaattttaaagggaaatatagtgatctgatgaaatccttgttttcattagtgatagaatacccccagttacgtatttcttccttacgtgccggaattgctttcggttcattcctagctctgtggacttcgctggcattcaaaatgggacaagctcctttctttgcaggaaacaatattgtagggttattaggattgtgcggcatagcaggagctctcaccgcctcgtatataggaaaatatgtacatgttttgggagtcaaacgactgaattacataggttgtggcttgatttttgtggcgtggttctcactttatttcggtcaggactcttacgtgggtatcatcaccggaatttttattatagatataggtatgcaatgtatccaattgagtaatcagactacgattttcgccctcaacccgaaagcagccaaccgtattaataccatttttatgacaacttattttataggtggttccgtaggtacattccttgccggaacattctggcattggtttggatggcaaggagtagtaggaacagggatcgcattaacagcctgttcctttatgataaatatctttgcaaaaagataaatcaagaatccatatcactcagatgcagttccagcgccttgacggaaatataaatctcgcggacagaaatgcctaaagaaataatgagcagcaccagtgccagtccaaaaatatatacggatatgaggtaaagctgtatatacattaaaaacatactgaccacgcaaagcaacaagctcccgatacctgtcacctgcatagcacgtgtcagataaaggcgtttgcggagattagaaatctgtgctgccgtaaccgccgaatgattttcacgatactgatccttcaacgtgcgtactaactgggcatatgacagaaaacgattggtatatgccagcataatcagcgatatggctgagaacaataaagcaggagttgttaaatctatttccatttttataggtatttcaaagttagaatattgcaaagataaagtaaatatcccgatattctccttcctttttacaatgaaaggaatatctttgcaataaaaataattccaataaactaatatgcaaaccataaaattatacataaaagactggttggctatccatccttatatccaacaacagactacagacagatattttgtcgatctggctaaccgattatactccacttgtacgataagagagattcccgaatccattaaaaagaagttatgtctttacaccgctgcctattttgaagatgtcatttcaggtttaggtctatggcaagcattcatcaaaaagcatctggaactatatgatacgtcacttcctttctataccatccgaccggattatataaaagatgagatcaatgaggaagatatccgtttcatcatttggaacactttagagaaggctccatataaacatctgtatatcaatccgatggacaggaatatcgaagaaactgcacatttatttttccggatattggatgaagaatatgaaacggctcccgccaatgccacgttacaggagttctttatggatttcaaaggaaaagaggatgcaaaccataaactacgctggctgttcggacatacttatctcacagaaccatctgtacaagaatatattgcacaggttacagaaaccgacaaattcatcattccatgtggcccccttgccctgtttcttcatgaatggattgacctgctgaccaacggagaaaccgaatgttgggaagagatagaaggactataccctgccattcccgaaatatcggacgagatgaaggaaaggaaccaccatacctatcaattgttcacgcaaggcacaaatggtgcccgtatcgtatatctgaaaagctataaagaactacacagtttccttacccaagtattacaatggccggacgattccaatcacactttgccccaaatgaaggaacataaggatttcatcatgatggtaaattccgaaaaaggtattctattggcgaaggatatatgcaaatacatcagtgatcctcttaacccgatgtatgatgccgcaacagctgcccaagaggcattcagcctgcttactatcccgaccaaatgtccgccggacctgatggaatatttaataaacaaccactatatccccgatgcacaattccccgaatttggtgaaaaggaactggttcaaaagaatgcggactttatagcccgccattccttattgtattactacaggggagattagaccctccccaccgctacttcgttcaccaaaggtctaccttcaacaaagtctttcacgttttgtagagtagtatgagcaatattcgtcattgcctctttggtaaaaaaagcctgatgtgaagttacaatcacattattgaaagacagaagacgagctaaagtgtcatcatcaataatcttatcagacttatcttcataaaaataaggctcttcttcctcgtatacatccagaccggcatatcccacttttttggtcttcagcccctctatcaaggcattggtgtgaatcaactgcccacgccccgtattgataatcatcaccccatctttcattttactgatggaataatcattaatcagatactttgtctgttctgtcaaaggacaatgcagggagatgatatccgaactatgataaagttcatccaaagtacaataaaccacctgatgttcacgggcaaaattgtaatcgggataaagatcatatgcaagaacattcataccaaatccacgtaatatctgaattaaaatcttggcaatcttacccgtaccgataattccggcagtcttgccatgcatatcaaatcccataagtccatgcaaagaaaagtttccgtcacgtgtgcgcattgtggcacgaggaatcttacgattgagtgacaacatcaatgccactgtaaattcggcaacagcatatggcgaatatgccggtacccgtaccactttcatcttacctgccgttgccgctaaatccacattattataaccagcacatcttaaagccagcagtttaacaccattatccgccattgcccggataacttcggcatcagccgtatcgtttacgaagatgcaaaccacatccactcctttggtcaacaccacgttattcatattcaaatggcctttgtaatacctgatatcaaagccaaacttctcattagcctccgtaaacgagtgttcgtcgtagggtttcgtgtcgtaaaaagctattttataagccataattattttttatttatagttcatataaataacaaaaacacgtcccttactgttcacatacagacttatagttttttcagttctgtgtacaggcactgcacagggagtcccatcacattgaagtaactacccgaaattccacagacaccaatgaagcctatccactcttgtataccataagaaccagccttatccatcggcttgtaaacccgaatataataattgatctcctcatcggacaattctgcaaacgttacttctgtcacagcagaaaaacttctctgagtcctggcagtagtcagacaaaccccagttatcacctgatgggtcttgccagaaagcttccacaacatctgccgtgcatcatcctcgttatgaggcttgcccatgactacaccgtccaaccatacaatggtatcagcagtaataatcaattcgtccggatgcatggtattccggtaagcagccgccttctcgcaagctatatacaaaggaatttcctctgctttcaatgtatccggataggtttcctctatgccgggtagtgtttttacctcatattttatacctaagccggataacaattctttacggcgcggagaattggaagcaaggattattttatatttttctaaattttccaacatagcttttctttatttcattaccacccgaaggctctttcatgagccatccattttccttgagccttcaaaacctgttccaccacgtcacgggcacatccataccccccattacgatgagaaatataaacagctgtttcttttatctcaggtgccgcatcagcaggacaacaaggtagcccacacaaacgcatcacttcataatcaggaatatcatcgcccatatagagtatctcctcatcctgcaatccatatttttccttcaaatgggcatactcccgggtctttaccgcagcagccagataaacatccttgatacccagcccctcataacgcttacgcaccgcctcggtatttccaccagtaatgatggcaacatgcagcccgcatttcacagccaactgtaatgcatacccatccttgatattaaccgtacgcatgggttcaccattggggtgcaaataaatagtttccgcactcaataccccatcgacatcaaataccaatgcctttattttctttaaatcatagtttatcataccacttatgagttctttccctctttatttgtctgaataacagacaaagggagattatgaatacttttacttatcttttcgtacaattcctgcaaagactcctcatccgccaacatctccaaatgtttgcttattacgttttcatcgtagcgtacagccggacctgtctgcgcctgtgtgggagaaagttcatgtactttgccggcagtttcgtctatcagcggaagcatcacttcaaaagaaatcccctgcttttccagtatatgtgaacttaatgcatacatatggttagcaaaattacaagcaaagactgccgccagatgcaaatgcctacgttgaccggaagtcacttcatacactttaggactgagacgaactgccaccatacgcagcactcccacttctgccggagcagatgcttctataaaaaaaggtacggtattgaaatcaacttcacgctgcttgctaaaagtctgcataggataaagtaccccatagcgttttaccaaccccttccataaatccataggcatactacccgccgtatgtacaaacaaagcctgctcccttcctttcaccaatacaggagccaattgtcgcaaaactgcatctttcagcgctacaatatacaaatcggcatcccgacgtatctcatccggcacaattgtgtagtctactaaaagtctgtcagccaatgcagaagcagactcctctgtacggctgtatacctgcaaaataagacaccctgccttttgtaaagcgattcccaaatgggtagccacattgccggctcctatcagaactattttcatcatcgggtcgaaactaaatataaaataactcctaacaacaacaaagccgccggcaacaaataagcagacatctgccccaacaaagctatcaccaaactgatattcaatatcagccatatacccgccaatacaattcctactgacttatcggccttgaaccaaaggaaaataacagctgcatacagtaacagattgtctttctgcataacccatggcaacccgtgtgaggcaaatcctataaacttatcgatcagataaagcatacccatcacaatgagaaacaccgcagaagctttatacgtatccttatgattgacagcagccacgtttacttgcctccaaatttattgatgtgaattttctcccattgtaaatggtcctcattaaaaggcttgcgttccatgcccttatgtcctaccgctataatggaaaccacctgcaactgcaacggaatatcaagcagcgtatgcacgtattcacccgagggcatcccggtagcggtaaaacgttcacgcacctgtatccaacaacttcccaaccccaaatcttctgcctgcaactggatcattatggaagcaattgccgcatcttcaatccaaacatcactagccaacggatcagccatcacaactacagccatagcagcatccgctagaaaagctgcccccatctccttacaatgggaaagtttttccagcatatccttatcatctaccacaagaaactgccagcaattgctacgtttagaagacggagccatcaaagcagccttcaacaaagcaaccacctcttcctgtgtcaactcttgatccgtgaacttacgcatactgcgtctgttctttattaagtcactaaattgttccataatatactcagttaatttatttttctgcacaaatatacaactagaatgtggattgataaacaaaaaacaataaatttgcaattagagatgcctgtcagattaagtacatatcgcaaaggaaatgccattccccctctgcctggaacaaacattttccattctaccgagttgtttcatgtctttgaaatgactcggggatacgaacctctgcttatcgtagcctatataggaaaccgtcctgtaggcaaactgctggctgtcatccggaagagtatgcgcttgttcccccccgcaatcatcaaacgatgcgagatttatggcacaggcgagtattttgatgaagaacagaataaggaagacctgttcggggaaatgttggaacatctcaccaacgaagtattatgcaaatcgttcctcatcgagttccgcaacttggaaaatccgctattcggatacaaagctttcagaaagaacaactatttcgccattaattggctaagagtacgtaactcactgcacagtaaagtcccttacgaacggctgagcatgtctcgcaaaagacaaataaacaaagcgttgagaaacggtgccatcatggaagtagccgacaatgagaaagatattcaagatttctcacgaatgttgaaaaaagcctattcctcacaggtaagaaaacatttcccggacatcggctttttccggctattagcatggcaaaacccagaaaaagaattagccaaagtgtttcttgtgaaatataaaggcaaaatcataggtggttctatctgtcttttctcaaaagaaagtgcttatctgtggttctcaggaggtatgcggaaaacctatgcttttctttaccccggtattctagccgtatgggcacctattacctatgctcacgaaaaaggatatgcacatttggaattcatggatgcaggattaccgttcaaaaagcacggttacagggactttatactccgctttggcggcaagcagagcagtacacgccgctggttccgcttcagttggaagtggctgaacaaactcttgtgcaaattctatatttaattcatttttgtctttttgtctaaagtgttgtgaagcatctcgcaaataagaaataaaattgaagaaatatttctttatttaactcgaaattactttctttgtgcagttttatctgaaaacttgagtataaaaccaaactattaaaattataagatcatgaaaatctcacacattgaacacctgggcattgccgtaaagagcattgaagaggccctgccgtattatgaaaacgtattaggtctgaaatgctacaatatcgaaacagtagaggatcagaaagttaaaaccgcttttctgaaagtaggtgatgttaaaatagaactgctggaacctacaagccccgaaagcactatcgcaaagttcattgaaaaaaataatggcaacggtggtatgcatcatttggcttttgcagtggaagatggtgtggcaaatgcgttagccgaagcggaaaccactggcatccgtctcattgacaaagctccgcgtaaaggtgctgaaggtttgcaaattgcttttttacatcccaaatcaactttgggcgtcctgactgagctttgcgaaaaaccataaaacacgagatctgactattcacgattgaaatcagtgtatttagtctggttcaagcgtaaatagaaatattttttaatcgtaaattgtaaaatcataagtaaaatgagcaatcaacttgaaaaaataaaagagcttatcgaacgccgggctacagcacgcatgggtggaggtgataaagcaattgcaaaacagcatgaaaaaggaaaatatacagcccgcgaacgcatagccatgttgctggatgaaggcagtttcgaagaaatggatatgtttgtggaacacagatgcaccaattttggcatggagaaaaaacattatccgggcgacggtgtagtaacaggttgtggtaccatagaaggacgtttagtttacatctttgcacaggatttcactgtttctgccggttctctgtcagaaacaatgtctctgaaaatctgcaaagtaatggatcaagccatgaaaatgggtgctccctgtatcggtatcaatgactcgggtggcgcacgtattcaagaaggtatcaatgcgctggccggttatgctgaaattttccaacgcaatattcttgcttcaggtgttattccacagatttcaggtattttcggtccttgtgcaggcggagctgtttactctcctgcgctgacagacttcacattgatgatggaaggcacatcatacatgttccttaccggaccgaaagtggtaaagactgttacaggtgaagatgtaagccaagaaaacttaggtggtgcaagcgttcattctaccaaatccggtgttactcattttactgccaagacggaagaagaagggttagccatgatccgcaaattgttaagctatattcctcaaaataatctggaagaagctccctatgtagactgtaccgatcctatcgaccgtctggaagactctttgaacgaaattatccccgacagccccaacaaaccatacgatatgtatgaggtgatcagcgccatcgtagataatggtgagtttttggaagtccaacctcactacgctaaaaatatcatcattggtttcgcacgtttcaacggacaatctgtaggtattgttgcaaaccagccaaaatatctggcgggtgtacttgacagcaatgcgtcacgtaaaggtgcgcgttttgtacgtttctgcgacgctttcaatatacctcttgtttcattggtagatgttccgggattccttccaggcacaggacaagaatacaacggcgtaatcctccacggcgccaagttgctgtatgcttacggcgaagcgactgtacccaaagtaacaattaccctgcgtaaatcatacggcggatctcacattgtaatgagctgtaaacaacttcgcggtgatatgaattatgcatggcctactgccgaaatcgccgttatgggtggtgcaggtgcagtagaagtattatacgcccgcgaagccaaagaacaggaaaatcctgccgcattcctagccgaaaaagaagctgaatacaccaagctgttcgccaatccttacaatgctgccaaatatggctatattgatgatgtgattgaaccgcgtaatacccgtttccgcatcatccgtgcattgcaacagttgcaaactaagaaattaaccaatccggctaagaagcatggtaatattcctctttaattaaaaattaaaaattgagaattgaacatgaagaaattaaatataggaatattcctttctttgctgctgatggtgggtttatgttcttgtggagaacagaaatcaaacaccaagctggtactgaatgaagtgctgattgaaaatgaaagcaatttccaagatgactacggagtacacagcgcatggattgaaatattcaatagatcatttggtagcgcagaccttgccggttgtttactgaaggtgagcagccagcctggagatactgctacttattttatccctaaaggtgatgtattgactttgatcaaacctcgccagcacgctttgttctgggcagatggtgaacctaatcgtggtactttccacaccaacttcaccctgaatgccgcaacgaacaattggatcggcttgtatgattcaggcaagaaattattggatcagattatagttcctgcaggtacattacaggcaaaccaatcatacgcacgtgtcagcgacgctgcaaatgaatgggaagtaaaaggttctagtgcagacaagtatgtaactcctagcactaacaacaagactatcaacagcaacgctaagatggaaaagtttgaagaacatgacagtgtgggtattggtatgtccatatcagctatgagtgtcgtattcgtaggcttgctccttctgtttattgctttcaaagttataggccgtatttctgtcaacctgagcaagcgcaatgccatgaaggtaaaaggtattaccgacaaacaagaagccaaagaaaagaaactgggtgaagctccaggcgaagtattcgccgcaattgccatggctatgcacgaaatgcaaagcgatgtacacgatgtagaagaaactgttcttaccattactcgtgtaaaacgtagctattcaccgtggagttctaagatttataccttgcgtgaaactccccacaaaaagtaagtcaccaataaaaagataaaacgatgaaagaatataaatataagattaacggtaacatatataaggttgccattggagatatagaagataatatcgctcatgttgaagtaaacggcactccttacaaagtagaaatggaaaaagccccgaaagctgtaatgaaaccggtagttcgtcctgcatcaaccagccctgctccggctccaactacagtagtaaagcctgctgcaacttctacaggaaaatcgggcgttaaatctccgttgccaggtgtaatccttgatattaaggtaaatgttggtgataccgtaaaaaaggggcaaaccatcattatccttgaagctatgaagatggagaataacatcaacgcagacaaagacggcaagatcaccgcaatcaatgtaagtaaaggagaatccgttctcgaaggtactgaccttgtaattattgaataatatgggagaatttatcaactttttagggaataacctagctgacttttggacatatacgggttttgccaatgctactgttggtcatatcgtaatgatcctgataggtttattcttcatataccttgccgtggccaaggaatttgagccgatgttgctcattcctatcggttttggtatcttgatcggtaatattcctttcaacatggaagccggactgaaagtcggcatctatgaggaaggttctgttcttaatattttatatcaaggagttacctccggatggtatccaccacttatctttttaggtatcggtgcaatgacggatttctcggcattgatttcaaatcctaaactgatgttgattggtgctgccgcacagtttggtattttcggtgcatacatgattgcattggcaatgggctttgatccgatgcaggctggtgctatcggcatcatcggtggtgcggacggtccgacagcaatcttcctttcatccaaactggcgcctaacctgatgggagctattgcggtatcagcctattcatacatggcattggtaccggttatccagccgcctatcatgcgtctgctcactaccaagcacgaacgtttgatccgtatgaaaccaccacgcgtcgtttctcatacagaaaaagtaatgttccctatcattggtttgttacttacttgttttctggttccgtcgggtctgcctctattgggtatgcttttctttggtaacttattgaaagaaagcggtgtaacccgtcgcttagcagaaactgcccgcggtccgctgattgataccattaccatcttattaggattgacagtaggtgcttccacgcaagcttcagagttccttaccattgattcgatcttgattttcgcgctgggtgcattgtcattcatcattgctactgcttctggagttatcttcgtgaagatattcaacttggtattaggtaaggataacaaaatcaacccgcttatcggtaatgccggtgtatctgctgttcccgactcggcacgtatctctcaggttattggtctggaatatgatcctaccaactacttgttgatgcatgctatgggtcccaacgtagctggtgtaatcggttctgccgtagcagccggtattttacttggattcttgatgtaattcattgaacaacaacaaataaaatcctcttcaactaatatgtggaagaggattttttattgatatagattaagaaatgaatgatttattatgaattttgaatgattagttatataagatatgctgaaaaacatataaatttgtcgccgtaaaaccaaactaaattaaacgaagatggaaaagaaaacagttaagtaccatattccccaacacggaatatatatgtacgcacgtactaattctgggaaaactgaactcattgtcctaaacagcaccaatgccgaacaagtggtggctaataaccactaccgcataatgacaaatgactcaaaaagcggtaaagaacttatcagtggcaaaaaaattgaccttaccaaaaatatgacagtcggtgcacgtcaatcattgattattgaattataattgttttttaaggtaagaaggtaaaatgagaaggtaagaataaaggtggctttataaagggtcgcctttatttatatctcttctacctcttttatttgcgtgaaacaattgtccctgtagcttgataagtaggcataaccaacatttctgcaatctgcatatattctggtacagaagcagcaaaataaacagtttccgcaatatcatctcccgtcaatggacgaatacctttatatacattatccgccttttccttatctcctcggaaacgaataactgaaaaatttgtttctaccaaccccggtttaatattagtcactctcaatggagtatcaactaaatctatacgcagtccatccgataaagctttcacagcggcctttgtagcacaatacacactacctcccggataagcagcatctccggcaatagaaccaatattaataatatgtcctcgtttacgttccaccattcccggtacaatcaggcgtgtcattgccagcaaagccttaacattagtatctatgacaatatcccactcatccagactaccttcctgttctttatccgtaccgataaccaacccagcattattcaccagtatatcaatggattgccattccttgggtaatgattccaaagcagacgttgccgccttacggtcgcgcacgtcaaaaggaagcaaatatatttccgtaccatattgcttttctaattcttctttcaatgcactcagtttatttacgttacgagcatttaaaatcaaacttgctccctgtgaagcaaacttgcgagcgcatccggcaccgataccgctggaagctcctgtaataaaaacaattttatccattttattatttcgatttattaaagaacttactgaaaaatagtatttgatagtctatggcattattccaatacctgcctgtatgcccgcccggacggatgataaagtcatgatttattttcttcttcaacagtttttcgtgtacagccttattcacttccagaaagaaatcatcacaaccgcaatctattataacagccagatcaccattttttatcttatccaactgattaattaccgtatgttcgtcccatctctgcttgttgctcgcttcttcgcctaattgcttcttcatctcccaattattgggaaacggacggatatctaaacctccgctcatactacctcctcctccaaagacatctttatgacggatggacaaccataaacttccatgaccacccatacttaacccggtgatagcacgtccccctctctccactttcgtagtaaaattcttatcaatatagttcaccaattcttttgatacgaatgtttcataacggtactccttattcaaagggctgtcccaataccaactgttcttcccgtccggacaaacaaaaatgattccttccttgtcagctatttgaggtaattccggttttataccgagccacgttcccgcattgcctccatatccgtgaagcagataaagtacgggacatttttcacctgccatggctttatccggacagatggtaattacctgaacctccttattcattgcgtcactatgtaccgacaaagtatccactttggccgcctgcattcccacagacaaacaccagcttcctatcaaaaaagcccaatatttttttttcatgtatataaaaaattacccgatgtaaaagtacaatataatttgcaatttagttgcatcttctttccactatctttgttgccataaataaaaagaaacaatgaaaaaaataaaattagaatcagttttcaatgaattcactttaatggggatagctgtatcaggagcattctatctaggagaatactgggaaggtattgccgttattctgttctatctcataggtgaatggttccaacacaaagctgtacacaaagcacgcagcaacatcaaagcattattggatgtacgtcccgaaacagccactgtagtatataataacacatataaaataacagcaccggaaaaagtacagccaggagaaaccattgaagtaaaagttggagaaaaagtacctctagacggatttttactggaagattccgcttcatttaatacggccgccctaaccggagaaagtgttccccggactctatataaacaagaagaagttttagcaggaatgatcgcttcagataaagtggtacggatcaaagtaaacaaaccgtatgatcaaagtacgttagcacgtatcctcactttagtacaagatgcagcagaaagaaaagcccctgccgaattatttatccgccgttttgcacgaatttatacaccgatagtgacaggactggcgatactagttgtcatactcccctatttatactctctgataaaacctgaattcatttttgtttttgatgattggttctatcgggctttagtattcctagtcatatcatgtccttgcgcattagtggtcagcattccattaggatactttggaggtattggtgccgcatctcacaaagggattcttttcaaagggggtaattatctagatgccataacccaaataaacaccgtagtattcgataaaaccggaacactcacccaaggtgtattcagtgttcaggcaatatcggcagccgaaggtgtttcgcaaaaggaactgcttcaacttatcgcctctatagagagtttcagcaatcatcctatcgcaaaagccattgtcaaatatgcggaagaacaaagtatatctcttaactcgtcactgagaatcactgaatttgccggatatggaataaaagccgtaacaaacggtaaagaagtatatgtaggaaatacacggttattatcaaaatacggcatctcttttccctatgaaatcagcaacatgacagaaacaatcgtgctatgtgcaatggaaaacaaatatttgggatatctttcattggcggataccccaaaacctgatgctgtacaagccatccgcgagctgaaagacttaaatattaataatattcaaatattatcgggagataaacagacaattgtttctaatttagccgaaaagataggtgtcacacatgctttcggcgatttactacccgaaggtaaagtagcacatttagaacaattaaaagcaaattttgaaaatcgtgtagcttttgtaggagacggtatcaatgatactcccgtactggcactcagcgatgttgggattgccatgggtggtctaggctgtgacgctgctatagagactgcggatgtagtgatacaaacagaccaacccagtaaagtagcggaagctataaaaataggaaaacagacccatcgcattgtatggcaaaatatatcgatggcattcggagtgaaattgttagtattgctattaggagccggcggaacggccactatgtgggaagctatatttgcagatgtaggcgtagctttactcgccatttttaatgcaatgagaatacagaaatgaaaagaataaaatgatttgacctatgaatgaaacaatctatttaaaaaaattggaacagcgggaaatcaaaccgacagccatacgtctgcttattctaaaaaccatgatgcagcacaaagaagcattttcactgttggatttggaaaacgaattggatacggtagacaaatcaaccatctaccgcaccataaccctttttttagcccatcatttggttcatggcattgatgacggcacaggatcgttaaaatatgccgtgtgcagcaatgattgcaattgtgaggtagacgatctccacactcacttttattgtgagaactgtcatcgcacgttttgtatgaaaagtatccacgtgcccatcgtgacactacctcccggattcaccgtacaaagtatcaattatgtcctgaaaggtctatgctcggaatgctctcatcaacatgtgtgactattgccaaaaaaggaaatcaatcctaaagcccattttgaaataatcgaatgcaggcatccgaatttacagatcggatgccattcatctaattgtcagttattcaaagctgtaatatcttcttgtatagtgtccgaccttttaatgaacatccatcaagaaatgcagtatttttatttgggagcaagaaacttcttactcagccattttcttacgggctcatcatacagtttcagacacaggcaagccaaaatgacactcaaaacaaaaacacccacagctacataccaagtttctcccaatgtataaagtttattctcaatcaaccatgcgtagaacaaatacatcaacggataatgtactacataaaccggataggatatatctcccaagaacttgcatatctttgtagactgcttatccgtagtagtacccgacgcccccagccacacaagaaaaggaaaaaccgcaattacacaaaaagcttcataaataccattcatgcaaatcggctccaatccttccagataaggaaccgagaacagcgcaatcagtataatagtacatatccaaaatgccccattcaccttcataggcttaaagttacgcgacatcaacatacccaacgagaatgggaaaagcatacgtaaggttccacctaagaaattcactccgtcgagtgtccatcccactcccatattcccataaccagacacattgaaaacagcaaatgacgctaatgccatacccagcaacacaaccagcacagccaatgctttattagacaaacgacgaatgaacaacgcataaagaatattacctatatactcaaaaaacagggaccagcaaggtccgttcaatggaaacatctcaccattaccacgaacttcatatcccacacccggcatggcaggaataaagaatattgtacaaagcaaagacaacataatcatggaaatggcgacatgcgttccatcccattgcacacaaccttgaatacagaacgtaatagctcccaaaacagcacccataattaccatcggatgaagacggatcaaacggcgtttgaaaaagtctttcatagtgaaattcttcccccaacggtcatcatacgcataaccgataacaaaacccgaaagaataaaaaagaaatccacagcaagatacccgtggttgagagtctcgatattaccggcactagcaaaagcaaagccttcaaatacatgataccatattaccataagagcagcgactcctctcaatccatcaagaagatcataatgaggctttgtatctgtaaatgctgcagaagagattttttccataataaattaatagatttaataattaattctttttaaccgttactaataatgctgcaaagttacacaacttaaaggcttttaaatttgtcctatgacaaaaaaacagtaatacataaattattttttagctcgaagacgactaagtgtgggaagtgttatacccaaataagatgcaatataccttaacttcacccgttggcatatttgaggaaactgttgtttaaactcctcatatctttcttttgcaggcaaagtcagccgttctttgtgagaacgatgcaaacgcctgtactcattttgatgaataatcctcccccaattagccaattcaatattagtctgaaacagcttggttaaatcaactaatgatattttgtaaacaactacatcttcaagcgtttccacaaattcctcgctcggcttattatagtacaactcgtccatactgaaaacaatacctccttcccatgaaaaggaggttgttatttcttctccatttacaagccagaaagaacgcgtcattcctttttctatgaaataagctgatttacaaaatgtattctcctttattaactgatatttcttagggaaacgacataaaatcatacattttttcagttcttgtatcgtatcttcagaaaccggacacaaagagagcatattatctataatgtttgtcataaaacctcagtccatttaaaatacatataaaaaaacaccaaatataaacacgggatataccttgttttcttttcagccaaaagtacaaatatatattggaaaacgacatcattttttccaaataatcggaatttccaagaccaccccatacaagaatgtccatatacctcttttatttattactttttgttcaaattacaaagataaagcattcaaatgccaatcaagcttttaaaacttcccattgcttaatgcaccactctaaaagaattgcaatagccttcaaatcacttttcatataatctatcagaaatttcataccaagaaaatccaaaagaaataccaaagaattgaacattttttatgaaaaacagcccttgacagattggcagatgcaggctatttttgcattttaacaattataacccttaaaacaaaaaaatatttactttgcagtatgaaatatctattatcagaagagtaaaatcttaattaataatctgctactgctttaaccaacaagtccaatcacatgaaaaaaattataacattacttttaatattgttgtttaccacaaaaagcactttctcccaatcaccaaacaatatagagaagttcaccgtagtctgtgtaaatgataaagatagtattttaaacaaaataaaaatgtctactccccaattctacaacatcggaaaaggtaaacgtatagagataaaagtatgcaatgaagacagcatacaaataagaagagtacgctgtcttttatattattccaactccggcaagaaagaatgtataggaaaaatatggatttcccctctcattggctacgaaacctgctatttttgtatgaacgtggatatccccctaacaaaagacgaatggcataaactaactttccgaataaagagaggaaaaaattataaggattacaaattcttgaaacaacaagtacaagaagaaaatatttgataagaaaagagatattgacaagaagaaaaacaggaagaattgtttttattttaagtttcagctttaaaataaaccaagatttattttataccattctgattatccttatatttgtcttttgataataaaactatgcaatctattaatttacaaaaacaatgagctatatccaaaacaatctacaagctggtgaagaaataaaatacaaagcagatattcactggtatatatttgcatatccggtaatactactattattaagcgttttcttttcttctgcacaaaccggatttttccattatgttagcttatttctattattgtccggattattccaattgataaaaagaattcttcttaagatgggcactgaatatgttgtcacaaacaagaaagtcattctaaaatccggtattttaagccgggatgcccttgaattggttttaaacaaatgcgaagggatacggattaatcaaagcctcatgggacgtatgctcggttttggttctattgtagttactacaggcggggtcaccaacaaatttgactttatcaccaatcctataaagttcagaaacgaaatcaatgcgcagattcaataaatgaaaagcatttaaagaatacaaagggggcggatataaaagcttttatacacaaaactgtaatggaactcctctgttaggataatataatctgcacttaggtttaagtattgtattaaaggtaatcaggaataccaaaagaatgttttaatatgtttattgagaatccttatcaatggggagtgtcgtatgactatgctttacccttgtcagaaaacacgcttttgcacatacattcacacggggctatacatacgtacaagcttatgcgtatgtatgtaaaacgctttagtccagaatgaaattccatatcaaagacaaggacgttttttaaaaagatcaagagcttttcaagaaagataaccgccttttttttaaagaacaagagttttttttaaaatgtcttgctctttttttatcgctgccgggaattcgtaagctagggactgtcgtaaaaagaataaaactttataacaaattgattgccaatgtaattgcgattatcaaagatttcaaagaacgatgtttaatttaaagtgcccactagtgttcagacatatattatataaatctgataaattctttcacacacagagataatggcaactaaacgctcacgtccttgttttataggggcgtggacgtcgttgtttattttgtgtgtgggcttaccagagccttgaaaacaaataaactaacgaattgcccacgcttcttcccatttataaaccgcttatcgggggcagatagcacaaatcttatttcaaaatgaaaaagaatttatttatgctttttgcagtcatattgactgcgtgtgtttttgcgtcatgttcaaaagacgatgatgacaattcgggtgcagcttccagtctgacaatgaatggcgaagctattaaggtcaaaagtattgaaggtgagtatgacccttctacctctttcagagcttttacattctgggtaaatgatgccagcgttattaatactggagtgtacattcaaggtactctatctaccaagctagaaaatctttcaactggaagtgatattaccagtaaattagggctattaatggaatataatagtggagatgaatatattacagatagtgattttcgttctggtaatctagtggttcaaaatattgatacttcaaaaaaggtactaacattagaatttaagaatttgaaatataccaataatcttaaaaaagaagtagtattaaatggaacgctgactatcccatataagatattagaataggaaatttaatcttttagattaaactgatacaaaaaaagtgtattaatcagtcttttataagattaaattgatacacttttcttttcgatacattaaaatttcacagctatgcttttaagctacttttttcgttctttttgaagaagttagctttaaaacagaatcctcttcaggggtggttgttataacccctaaaagcaagtcatcccagtctaactttatacctttatattcaaatctgatgaggctattaagagtttggtcaaataggtcatacaaaaatctattatctatcaatgaatagaaagacagttcttgtttagtacggttcaaatattcttttacttcgtcattattcaaatgtacttccagacgatgtaacttgcctggattattatagaactcttcaatgtactttttacccgagctattggctatttctgcctttttattatacgctgttaaagtagtacccttacccttatcttttattgcttttttttgctttatagaaactgttaaatacttgtccttattcatgtttccactggttatataagtaatttctggacggtcttcattacggtttttaacctctttagtattgaggaaggtggttacatttttgttgcgaatcagccttcgaatcatccgagccacatcacaagacaagtctaaacataagtccaaagcagttatattatgcagttccagacccaaattatcttcaataaaatccagataatatatttcatcactatataacacacgattactcacactaatccatgccttagcataaccattagaatgaaagttactatcttctttatcatcgttgatacctaatctcaattctccgaataacttatcaatgcctaaatcattgtaacggatttcatatacaaatttgaaatgtttaccctctatacgtcttaagtagaaataaagaaagtctacttcttcatctatttcccttgttctgagaatattgatattgttcggctctttgatttcgtaacacaaccgaagcatatctatgtttaacccatatatcttattcattttcttcatttttagtttcgttattatttggtttgtttggcacttgcttccagtattttttaagtccatctgatatggattgtacatgtgtcgcacttttagttcttcctcttaaggcttgactaattttttgtttggtagtatcatctatctggcgatactgtctcttgtagttagtttccatagttttggttatgaattttatatataataattagttagtttaataagaaagtaaagattagtaagctaatttttgaaaaaaatctggaccaaaatttcattcacccaatcgtttgccaaatcaaccacacctactaaaatgcaatattcagagagtcgggttacagtgctatcccttttcctaaaagggaataggaacttatttcttcctcaaaatattttctgtttgtatattaccgtacttgcttttttccagaaaaagaagcagtttaaacgtatatctatataaactttttataccttcgcaaaaaaaacaatggaaacaactaaagtatattattgctctgatggcatgtattcacgtgaaatagaaagaaagtctgtaaagtgtccattttgtggagtaataaacattcctgaatatctttttctaaaaaacgtagaaggaagtgattttctcaatgtatttactcaatgcactaacccgacatgtcggaacatgttcataacccaatttagcactgtaggggttaggaagcctgtctttacaaaaattttgcccactgcacttcccgaaaaaagaacctttagtgacattatatctgaattatctccaattttttgtgaaatatacaaccaagcatatatagcagaacaaaccaacctcatgcaaatttgtggtactggttacagaaaatccttagaatttctaataaaagattatttaatttcaaccttacctgaggaccaacatgaagcaataaagaataagttcctcaataattgcattagagacaacattagtaacatcaacattaagacagtggcatcacgtgctgtatggctcggcaatgatgaaacacattatacccgtaaatgggaagataaagatattaatgacttaaaatcaataatagagttaaccctccattggattgaatcagaaatcaggacgcaaaaacttttagaggatatgccagagttcagatgaaacaatcttctcaaaatccactataaacttgttcgataattcgatagtgtagccgacactgtaaaggataagagggtgtatcgtaatgaacgatgcactcctttttcatcatgccctatagtaaccagttaactgaaatgaagacttatccaagaattatgagaaaagattattcgagaattcttgcccgatttcaaaaagttacatttttccctaccatagtagttggaatcctgatacaagttctgccggatcctgcaccaagttctgtgaaatcttgtgccaagttctgcctcacgacctcactcttccagtgaaaagactaaatatttacttttagaaataataaagaaaaatatagatagcgctccagttctgccacaaccgccaatcgggagggaacggcaaaccaatgtcctaaagcataaaacctctgcggttaataaaaggccggttaccccattacatgaagtaaccagccatccattatcctgttacctagttaattatcaaaacttataagctgctttacgtaactctttcactgaaccaaatggtttattgggcttcaggtaacgacccatgaacttataaatgtccagacgaatcttgcttgactcataagtgtctaaccgatcaaaactatgcgcaccgggagcacgctcaaatatcttatattcaaactttttgccttctgctttcaaagctcgaatcattgattccacttcgatcacatttacatcatcatcactggtattggtgtagataagtaacgggtctttcaacttctccgcatgccacacaggagagcgccgtttgtattccgcaatattatccttggcagtctgcccgatatgattcttggccgaaaagattttgcgataactgtcgctggcatatcccatacgcatgattacatccgaaaccggtacaccggcgaaaccacatttatattgtcccggataattgaaaagattcatcagcgtaatcataccaccatgactccatcccatgatacccacacggttaccatccacaatatcaaaattgtccaccatatagttacggctgatatatacatcctcattctccaatccaccataatcaatattattgtatgtacccgaaccatatcctgtacttccccggtaatccgctgctaccacaatatattcctgcgctatcaactcgcggatgatatgagcataataggtgtccatatcggcatgtaccccactatgaggaaatacgattaacggatatttcttgttttcatccacgcttttgggaataaaaatgtatgctctgaatttaagttcgttaccggcactcatcgaagtagggttgaactccttccaacgcggtggtccacataatattaccttatctacatgggcgatatcacccactttctcgtaccacaggacatcatcaatttttttcattaactggtcaaactgatgaacggacaactgtgcccgtactattccgggcatactacataggcagcacaccaataccacaaattttactattccgtttttcataagcatatatttaaataataattatatagaatatcaactcttggggtatcccggattttgttccatttcaggactaaagataaactggtcctcaggaatcggcaacacacatttataaaaatcccaatccacttcttcgtccacactgggcaaatgatatcctcccttccgaataatagtcttaccattccgcagcaaatcaaagaaacgatgtccttcacctaccagttccttacttcgctcgtccaaaacacgatccaaagtatagtcagccattgtcacttcgttttcaggattaccccgtttcacaatatcgttcaaatagccaagtccctgaaccgcagcatcaccacccaacttacaaccagcctcagcagcaatcaggtacacttcggacaagcgaaggaccacattattacattccagcggtgcagtcttcatgtccgtccctctcagtttgtacaaccaccataccgtttttcccgcatatttattctcctccagcaactgcccacgcacatctcccggatcagccagcatctgctccgcatatttctgagtgacaaatcccttctgatagccataccagttcaataaatacccccatgaatcccgtcccggagtatcatccacactattggctatctcaaaaaacgattctgagccaaacttggtttccaccgaccaggcagccacatatttctcatgcggataaagtgcatagcttcccgatgcatccacatcctttatcagttgctccgccatatcaaacgctttccggttatcattatgatacagataaacacgagccagcaatgcacgggccgcatacttgttcatacgtccgttatttttctcttcggacatcaatgtaaccgcctcttccagcgtttctataataaaatcgtacgcttgagcaacagtagaacgagaaggattttcgtatgttcccaccaaatgatctatcaacggagcacccagtgacgcaccattatctttcgtataaggatatccaaagcaacgggtcaaatcaaactggcaaagcgcaatcaccgccatcgtttcacctttcaaagcattcagtttcttttcatccccactttcaatttttccttcggcaatagcattcagaatattccacgcctcacgaagaatataaaaaggtcgtccccacaatgaaccggcattcaaactattaggacgatgattgaacatatagcatgtattgcatactccactttcctcagaactctgcatatcatcccccttcatatctccataggcaaacatagcagccccataatatccggaacccgacatcagatcatacaatccattcaccgcattatccacatcggttactgtacggaaagctatagcagtaggaatcttattgctaggagctgtatcgaagaaatcaccacaaccggtaacaagtagtgaagctaatcctaaaataaaaagtatttttttcataatggttctgtttttagtgcaattgatgattaaaatttaagttccaacccgaaagcataagttttcaatggaggggtgtaaaatcctaccacgccactcatctcaggatcatattggccgtaagctgcccatgtcaacaaattcgtacccgagaaataaatacgggcattccctattcctaatttctgcaaccatgctttaggagcattcaatcccaatatcagacttttcagacgaatatgatccgtagaatggatggcacgcgaagaattatagttacccccttttttattcccatatacaaaacgggggacatccgttatatcacccggtttctgccaacggcggcgttgctcggtacttttattgcttatcactgaataaccatcatcttgcagaatataggatgcattatcatacgaataaccaccgaaactataagataaattgaatgacaagtcaatgaatttataattaaaggtattcataaagcctcccgagatagtaggcgtaatatctttcaacggaataggacttgcctgccccggatcggtcactttattttttgtataattgccattctcatcctgttggttatcataatacaaggcacttccagtctcaggatccacccccgcatactcacgcagataaatagtattaaatggataaccttccttacgtacatacctgccatccacaaaccaaggcagatctgccagtttcagaatcttatttttattatggctcaaattgaaggcggtagtccagctaaaatctttcgtcttgatgttattggaacgaacttcaagttccacaccggtattccgcatctgtcccacattggtcagcagagaagaaaaaccgctgatggaattcaattgcttgctcatcaataaatctttcgttgtacgcgtgtaccaatccaaagaaacattcacacgactgaacaagccgatatccagccccaaattcagtgcataattcttctcccaagtcagttcctcattccccaatgtactttcccacggagaaggttttccattataaaacgcccctgtggtataagtactctgataaccataatatgaagagggaagattcccattcaccccataggaagcacgaagttttaaatcacttaatactgatttcaacgactgcatgaacttttcctgagaaagtctccatgaagcggacaaggaccagaaattcccccaacgagtatcgggagacaagcgggatgatccatccctgcgaaaactgaaactggcataatatttatcaccataagaatagttcacactagccacataggacattaatgcatcttcctgcaatttctggtcagcatctatcggatcggctgcatttcccaatgaagtgttgatatcctgcccgtaagttttctttgcagcatacaaatcctcataatcatacttcatcacctcgaaggcagcgaccgcactaacagaatgtttaccgaaagttttagaataagtcagattattctgtgaagtataccgcatacggtcagtcatctgcatacgtccccgtccctgataagtagctccatcacgtccttcaggagactgaaagaaaaagtcctttgtcaacgaataatctaccgtaaacacactggatatcttcaaattgtcccacacattataagctattttagccgtacccatcgcacgtaccgtccgagcataataatcattcacctcggcctccaataccggattatatccattgttttcacgatacccgctggcatacgttccatcctcattataaatgggagtagaaggcgtcagattcacttttgatgcataaatggcacttccataaaatttaccctcaggtaaatgaacgttctttgtccacgaaaaagaagcgttcattccaaattccacctttttatacttgttacttgcatccacacgccccgtaaagcgctccatttctgaattcagggaaacacccgtctgcttggtatatcccaaagaaccgataaaactggaattttggttgccggcactagcagacaggttataatcctgttgataacctttcttgaacagagcgctttcccaatccgaatacccctgagacaggcgtttggcatactggtcgatattcgcatcagcatactgctgtgcctcttgttcacttactcccttatccagttgaaaattaaccagtccttcatgaatcaattccctcctttcctcacctcccatcagcggacgatatgtataagcgaaatcagtgattccatattttgccgccatattgacacgaagtttaccttcttttccttttttagtagtgataagcactactccattagcacctttcgcaccatacaatgaagccgaggctgcatccttcaaaacagtgatactttcaatatctgccggattcaacgtttcaataactcccattcctcccgcttcggacatactggtaaagttactcaagtcataagatggaataggcactccatctaatacatacagaggctcggtggaagcattcatagaagcgattccccgtacccgtaaagttgttttcgcaccgggttgcgaagaagtaccggcaactacactgatgcccggtatattcgattcaatcatctgccctacggatacaacaggtaatgcctccagtttttctgtagtcagaacagaagcagatcccgtataagttgccttcttgaaatctccatatccggtaacgaccacttcgtccaacgtattggcatcttctttcaatacaatatgaaagtctcccttcccttttgtcggaatatcctgtgccagatatcctatatagctcacaaccaacgaagcggattcgtccacttccaacgtaaactttccattaaagtcggtgataaccccattggtgcctctacctttttccaccacattggcaccaatcagaggttctcccattacatctttcaccactcccgtcactcttttctttttagaaccaggccgcgaaacagctttcttctcgatgaaatagattttattgtttctgatctcaaaagtaagatcagtgcctgaaaggagtcttgtcaatgcctccttcagtgtaacatctttgagttgcatggttaccttacgattcacatcgaccaactggtcactgaaaaccaagctcataccagtctggcttttaatagatgccagtactttttccaccctctcattcttaaagtctaaagagactttttgcgactgtgctgaaacagtaaagccaaataaaaggactcccaacagcagtaatgtcttcattttggttcttgctttcattttcatcaatagtattagtttgaaacaaaagaatttcttatataggctaacacatcactccaaagaaggtatgagtccatttttcattttttagaaaaaaaatagatgcaagtgtattcactcacatctattccacttttcttctataaccctcgttatttagaagttacttcaaatacaccttcttctatttccgtaaaaacaatattcgaaacggcttccaaatcatagagcacatctgatgcattgacttttcctgttgacagagtaaacctgttcttcaataccgcagaatctttcactatgaaatgaacatcataatgtctttccattacctttataatttcaccgagtggagtcagataaaaattaaggctgttgacacgccatgccgaaatctgttccatattatccggacgggagatcaggcatttccccgactgacggttatattccgcactctcccccggaacaagtctgtactccttcgcattatgatctctgaaaagaattcctccttcatccaaggttatccaaatattgggttcggcggaatatgcctttacattgaattttgttccagttactctcacttccaccccttgcaaatccaccttaaaagggcggttctcatctttggcaacattgaaatacccttctccccaaagctccaccgtacgattgaacaatccaaactgcttgggatacctcaagcgagaatccgagttcaaatgtacaatactgccatcctgtaaaatcacccggatctgttcaccataaggaacatttatgtcagcatattccggttcagagaaaatgcccgtccggtttgccaaaaaaaacaaggaaacacttaaaaaaacaaacggtaacagcacagccgccacccacatccatctgcgaccaaccgggcgttgtccgcgctcacattttatctcattcataaaacgcactttcatctttacttcaggtatggaatgcgggtcaatactttccggcatctcttccgacaacatcccgatttcccagtcaaagcgttccgacaaatacttattaccttcttccgtagcaaaccaaccagctactttccgagcttcttcaggagaggctttgttgtcaagcactttagctatcaccgactcatctatcttcataatctatttttttgtatatttataataacacctcatcacaacaaaagtatgagtacatttcagactattaaattaatccatatcacaggaaaccatataattaaagactctatctcgttacggagggcttttatagcctgtgtgtaatgggatttcacagtaggaacagttatccccatcctgtcggctatttcctgattggataatccatattctattttcaacaagcagattttttgtttctgaggaggaagcttatctatagcaacccgcaggaattttccgagttcaccattttcaaattgtgtcaaaaagtcgtcttcatcttcatcattcacttgttgggccatttcgtatagtttctcgaaaaccaaactacgatgcctcaattcattcagtatataattctttaaaatagtaaatagcaaactacggatacccgactcaaagctaaaatttgtccgctgctcccacaatttcataaaaagatactgaatcgcatcttccgcctcttcttctgacttcaaaaaacgataggctatggtatataataaccggttatagcgttcaaaaacagcggcaaaggcatattctttcccacggcgaagatcgtcatatagtttctgatcaaaatccggatattgattcataataaatgcttttcctagttttattaaaaggccgacttaacgcaaagatagtataattgaacctatcttatctcagaatactcaaaaaatatacatcatttcgttttctagttctagaattctttacacaaaataagttataaaaatcactttttgatacggaagaaaagtgaataagacaccgtgatatcttttatctcggcgtcttattaatcacatgccggtgtattatcccggatttgagatataaatccgaatccctgcaatgaccctacttgaacaaacattttactccccaactccagactccgaaagttacgaatatcccttcttataaataacagttatctctgatataaaacttggacccgaaagattatacatcttacaagtgcaacatatataatgataacacctgaagatttataatgtgtcacggcatcttctatcaattaaaatcataattaaaccaatcaaaataacatttaccgcctattcccaacgtattatatgaatacaagcccacacgcgcacctttccaatcgccgaactttaacgaataagcatctccacataaaataaaattacagttatcaaaactatagaacaactggcagcgattcttctttgcatccaacataacacgtaaatagatttttttaccggaaaccatctttacttgctgaacgtcaccatttttttctaaatacagataatttttaccttcctcacgactaatgccaattccgttataaagactgcctgtgcagaacaatccacctctttgtccatcagccagcgctgaaaaatcaagcaacacagtggctgtgcttagataccccatacatttttgagttaacatattgcgagattctcttaatgttgcagccttcaaggctttcaaagcaagccagcccctacgctcatttaaactccaatgagtattcactggattatgattaaactgccattgcagccctaaagtgtaagaattgaaatcatcagtcgtttgagggtgagaaacaagaacacttttgcttacaccaggctttgtccaaacctttaccggctcacctatcccattcatatccatatccacccctatcacgggccaattctccatccaacaaacaggctgcaaatgcacgacacgtcccaaaggttctgtcaattggaaatgaaaaaaccaccattctccttcaggcgtatctactaaagccccttgatgaggaccatttacagtagtgtttccctgttccaagactactttcttttcgtatggtccatagatattttttgaacgtaaaatagtctgccatccttcgcctactcccccttcaggaatgcttagataataataaccatgccgtttataaaatttagttccctcagctacaggacctgtataaataattttcccatcatccaacaaagttttaccatccggagtcatacgatgtagataaataggacctgcccctaactggctacgccccatgtaggcctgtccatcctcatcccaaaaaggacaggggtcctcccagccgcctatattcttcacacaatgcaacggcgtccacgggccatgaggatcagtagcagtactcatcatcagtccttctctaggtgtacaaaaataaatccaaaatttaccatcatgaaaacggatagcaggcgcccaagatcctcctccataattttcattattatcccatccgggaaaatcaaaccgattatacacttgactgatgattctccagttcaccatatcatctgattctaacaccggcatcccgatataatgaaaatcagagcaaaccatataatatttatctcccactctaatcacatcaggatcagaataatctgcatttaaaataggatttatataagttccattaccttggtcaccccaagaaacagcttgtccttgtaccttttccgacaaaaacagcaaaacaaacagaaaagccaaaaagaaaaatctcatagtatcattcatcattaaaaaagaaaattgccttcatcattcctaaagataaatgataaaggcaatacactaaattatatacaatcaatcccaaatcattcagctacaacttcaattacgcgactgttaagttgctgtgcagtaaacaaattcaatcctacattcatcaaaaattctcctgagaaaacctcaccattacctgataaagaagagttggctccgggcattaagttaatttctttcacacgatacattttgtctgcatcaagcccctgcaaacgcaccggcaatattttttccgcataacgaggatgaatatcgaaagcaaataccgctgctttatccttatctttgcccacatacatagtagaggtatgattactgccataaggagaaactaaacgatacatatcaccttccagaactaccggcttcaaacggttataattctgcacagcagtacggcaataagtttcatcatccttactcatatccgctaatttgatatcaaaaccaagtttgcacatcatagccacatccgtacggaatttcacactgctattcttattccatgtagtaacatgagcgcacattgtcttggctgggaacacctgtgagaatccccactgaataaataaacgttcaatagggtcagtattatcactaggccagaattctgtaaaatatttcaaagcctcatagtctgagcgtccaccaccaccggaacaaagcatcatcggcaggttaggatattttgctttcacacgctccaatacattatacaggccacgcacataatcaatatataaatgtgactgtttatttttcaaataaacagagtaaatattcgtaataggactattgcaatcccatttgaagaaagcgatatcaggatatttagtcatcaaattgtccacaactccgaatacataatcctgtactttcggattgctcaaatccagaaccaattggttacggaaataatactcgtcacgattcggaagatgaatcacccaatctttatgcttttcatataattcacttttaggattcaccatttccggttcaatccaaataccaaactttataccttttttcttagccgcttccgtcagataacctacgccgtgaggaagtttatcagccgtttcatcccagtcacctaatccttgatggtcaccactgcgcggatacttgttggcaaaccaaccatcatccaacaaaaacatatccacacccagttctactgcatcatccatcagcttcaccaatttcgcttcatcaaaatcaaaataggtggcttcccagttattcaacaaagtcatacgagtctggttcccatccttcacctgatacttacgggcccaatcatggaaattacggctagcctgtcctttacctgtaaaactgtaagtaaaatagaaatcgggagtacgaaagatttcattcggtttcagactatattccgaagcatacggattaattcctgatataacacggagttcattcttattatccacctcgaatacaaaactgaaattacccgtccatcctaatgttccgaccaacacttcaccttggttctcttctgattttccatccaatgaaagttggaagaaaggagagcagaacatattggcacgtgctcccaatttagtatcaatcgtttttttaccaaattccaaaggttgttccttcacatgcgcctcactagcccagtctcccgagaattcagtcaggaaatagttgtcacgattcaagtgcaacatggaagacgcgtacttatgaagctgcacaggtttcttttcctggtggctgatttcagtgaaagtctttatcaaattttctttctgataagccacataatgaagttttacagttacaggatatttatcatcctgcatagtaatcaccacttcatctacccccggcgacacttgattccgagtatgagaaacatattttaataaagtagaaggattgccatcattatgtactatatgaatagccggttcaaaataatcttccatgccatgagtaaggtatgcttcgctaccctgtggcaaatgggcaatatctgtagcataattcaacttctttcccaaataactttgatatagacgtccgttattaccaacccggtaaataaggtctacattttctgtactaattttaattactggcttatctgccgcttttaacataaatgatatgcataaaaaacatatcaagaagaataatctttctttcatggtattatttatcgattaaaattatagtgcaaaaatagggagagaagctcaaaaatccctactcaaatgcgccataaaataagaattttgacgcttataccctcaaaatcatcgaaatcaagcctgtattgtaggtaaaatcaaggaagtctgctatctttgttatccaattctaatacatggatatatgccacgaattaaagagggatttaaaggagaacgcgccatcgtacttcctgcttttctgattgaagaattaaagcaagatccgttaggcagcgaactttacattacagatataggatattatcctcatgcctgttttcattaccggaaacgcaacaccgaggaagcaaccgagtttatccttatttattgtatggagggagaagggtggtttgagttagacaaacatcgatatgtagttaccgccaaccaatttttcattctacctaaacaccaggcacacgcttatggcagtaatgagagaaatccctggactatttactggatccatttcaatggaacaaaagctgcatttttcagtgccggttttgaccgtccgaaagacatcactccacaagaggattcacgaatcaaagaaagattagtactcttcgaggaaatctactcgtccatcagctccggatatagcaaaaactatatgctttatgccactaccagtcttttccattttttaggttccatgaagtttattggtgaatatcgggattgcggttctatgcgcaatggttgcagaagcaaggatgtggtgcaaatagcgattcatttcatgcaagaaaatttgagcaaaaccattcgcctagcagatatcgctgcggaagtaaacctctcagtttcctatttctccaatctgtttgaagaaaagacaggctcctctcctcttcgatatcttacctatctcagaatacaggaagcctgtcactacctggattttactaacctaaaaattaaccaaataagtcccttggtaggctatgaggattctctttatttctcccggttatttactaagacgatggggatgcctccatcagcttataaagaaaagaaaaaaggttaagacttacaccatctaccaacagtcggtccggaaaggggcaaccgggagcccgttctctccgtacaaattacaatccggattatctgcccagccataacgtgcagcaagaggggcaggaacttcagtagaagaaagtataatttttccatcatggaccatagcctctgccggataaaatacacggtccggccctgcaatagtaaagccttttaaagttgtacctttaatctgaaatccatcttgcttttgtccgaaatccaattccatcttgttccccttaattatataattttggaatacaggagccgaacttgaaacattttttccataactaccggccagggcaaccaaagctaaacggcgtcccacctcttgcttattcttaggatgaatatcatcagccaaaccaatatcaatggtcacggccataccaacttggtcaagttttaatgctttagtttgcgcttcacgcaaagccgcccattcggaatccggctgtattttcttggattccataaaattagccaattgtacaaaataaaaggggaaatcactccgccattgtcggcgccaatccgtaatgagagcaggaaacaaatctccatattgttctgaacgacctacattagcttcaccttgataccatattactcctttaatgggaaaagcagtccatggtttgaccatcgcattgaacagcaccgtaggataactggagctttgaacaggagaaatcggtgcaggtggaaatcctgttaaagaaagtccgatacgatatttccaatctccagccaaactgatccgctttccatcagcttctacataaaggtcctccgccttgccatgaataccgccttctccaccaaaatcagaaacacgaacagcaagaaccgccttaccagccttcactagttttgcaggaatggtataagtacgcggtgtcatatagcctgcccctcgggcaatctccaccccattaaaataagtgatatcttcatcatcaatcattcctaaatttagttttaacggtttaccaatccattctgctggaatttcaaaactacgacggaaccatactactccatcaaaatttttcaatccattcttttcccagtaatcaggaaggcacatatcccaccattgtccttctgacaagtccggtgcaatccagcaaggcttatcttcctccattcccttatcttccttagaaaaaagagattgccactcagagcgctcttgattataggccttttccatacgaatagggtcaaagtccaattgttccatcttagccaactcttcacgaaagcccagcacctgtttcaatgtttcatagctggtccacgcttcagcaggcgttcctccccacgtacagtcaatcacacccacagggacatttaattctttccataatgaacgggcataaaaataagcgagtgaagagaattcaggaattgtggcggaagaacattcctgccaacctcccatagtagactccatatcactcaacggaattactgaagtattcttcttcacttgaaacaaacggatagaaggataattcgcctccgttatctcctgctcataattcatgactttcccccaacccgcaacaggcatctccatattagactgaccagaacaaaaccatacctctcccaccattacattttttaattgcaatttcttaccatccgtaaatgtcaacgtataaggccctcctgcagcaggagtaggcacagacaaactccaataaccgtccttattcacctgagtcacatacacttcattattccagcctgtagttacctttaagattttacccaataccgctttaccatgaaaagtaacctccgtattttgctgaagaaccatattgtccgtaaagtaagcgggtaagaccaccttggcgtaagaatttacatacgccaagagagaaacacataaaaacaatattttatttcccatatttaccaaattcatttgttccactattatattcttctttaatcatacatcatcggaagctacaccaatctgaatttcaaattctccaagctccaccaactcgcatcttatttattattataaggtgttaccaacaatttataggaaccaccttgcaataaagcctcatcaaaagtaatacatatatctttggtttcacccggcatcaatgtgaaataattgtcattcataatagcaggaagaatacgctctccatccgaggtccgaacagcctgaacatatactgcaaacgccacaccttttgcagactttaggtgagctatagctgcccgaatctctgcctgaccatttttacgcaacaatttagaagaaactttcaattcggctgccggcaaagtattcaaagccgtaaagtccaaacggtcgttgccacgccaataattgttttcagaaacaacctttcctgatttatctttcaacgtcaggcggataaaatgtacatcgctcaaaccctcactaggctgtgttccacccaatacatcaaaactccataatgaataaccaaaccaccaacctagttccgtcccaaacatacgtacataacgggcatcaacttcggggaaagtaatttcatctattcctccacgtccttcatcagttttatatacttctttccaagtctcggcgtcatctgacacttgaatcttatatcctttaccaaaagatgcctcccaattcaagcgaaccccacctacgggttgcacactgcccagatccacataaagccattcattttccgcttttgccgctgcccaacgggtatcttttttcccatccgtagcatctgaaggctgtccataagtggtacttgaagcaaaggtcggtttatttaatgacaaatttttacgctctttattgaaatctatcgtaaaacattgcacagtagaattgctaggagagttcacaatagctgattttgtataagcctccacagactttccatccagattgtaaacttttacttcagcagtcaaaccttccatatcacatgctgtggtattagcaatcttcacaccgtccgtcacaggattccaaagaatatgcaccggttcacaggctgattttgctccccaaaaggctcctgtcaaatcataataatagtcataagtttgccaaaccatagacggatatgccgactgtcccatccaagtcatgatacctgatgcatcctcccacatacgatccagccaaccctcatacatagccttattagattcaatattgacaagctgagccttacggcaataatcttcaatcccttcgggcttgccaaaacctttggttatagaagcatcataacgatcgggagctgcattaaaagcattttggccaaaatagtgcttgttccacatttcatcacgaggccaccagttctccttgggcataaatttcttgaagctttcaaaggtaggaactacagctgtgccaatttctgtacgaaatccccagccacgcgccggatctccttccaagccatcaggatatttagtaaaataaaagcgaggctcaaatgctccccacggaccactaccggtcaagccctgagcatgggagtttgcttgaaaataacgatcacctccatcaaaagtcctgatattttccgccatccatccttctaaaggaggctgaggattagattcattatcgccacaccacacggctatactagggtgattacgcacacgttttattttctccatcatattattattgaacacattgaggtcataaggcaaattcggattagagtttatccaaaaatcatcccataccataatgccatatttgtcacatgcctcgtagaattcatcatctgtaacagagccgagccaattacgtatcatattaaaattcatttccttatgcaggcggactttggtatcatattcctcgccacggcaacgaagcatatattcagacatcccccaattcgctcccttaacaaataccggaatatcattaatataaatatggaatgtattgccctctttatcataagaatatttctttataccaaaagaaacatctttcgtttccgaaactcttccatccaccatcacctcaaacttacaatgataaagattgggttctccatacccatttggccaccacagacgcggctggtctatacacagttgtggaaaatagcgtttgtcaaacttcacctgttcagtagtatgggcattcacgtctaattctttttgaaaaacaatgtttcctggggtaattgttccgcgcaccaataccttcgtcttttctaccgaattattcttgacatcaagcgccacactcaaatccgctctggcacgggtaggtaaattagtacgtatccaaggatcaattaaagtagctgttcccgtattagtaagaaataccttatcggttataccactattcaaccccggcacataaggcatccaatcccatccgccactagacaaataggttggactgccctgattagccaatggagtatcaggcatatgaacaagtacagccaatacattttctttatcacgatttactattgaagtaacattaaaatgtccacgatgcataaacccatccagtttacctaataatgttccattcagatagacttccgcacgacggtttaccccattaaaattcaaccatatcaattcttttgtaaaatcagcaggaacacggaatgtagtacgataccaaaagctacagtcgtatttgtctcgatttacctgatgaatattgtcaccaaagttaggatctttctccagccctgctattacatacgaattaaaagctgttccaggcacaacagcatctacccaagcagaaacattgtatccgtttccacaaagtgacttcacatccgttccgacttcagcctgaggctttaacttccatttcatttgtgggttatcgctatgtaaatacacagtttgagcatgcagtacttgcatacatcccagtagggctaatacaacccatgttttttttacgtttttcatattatagtcttttcatatttatcaatcatctatttctctttttgcacctgaaaactaaacaaggtgcaatgctcataagctttctccggtaacaccaggcaagaaggaaaatccgaatgagaaggagtatccggataaaattgtgtttccaaacagatggctgtatccggtcggtcataatatcccgctgtatacaaaagaacagcaggcaaatcagtcatcactgtcatttttcttcctgtaacaggttcatataaagaagcagcctctaacatctcctcagacattttatctttcaatatatagcaatgattatatcctttattccaaagtaattgctcatgatcagcatataagtctgcacctaccggttttagggaagtaaagtcaaacggagtatttttcaccttcatctttcttcccgtaggaatgaacgccgaggtagtatccaatatccggtcagacgaaatatgcaaccgatgctctgttatcttttttccatttccgcacaaattgaaatatgcgtgattagtcatattgatgtaagtagcacagtctgtttccgcataatgccgtacagaaagttcattgtcctcattgaaacgatagtctgttatcacatggatatttcccgggaaacctccttctccgtctggcgaatacagactaaaacggatgccatccggtaattcttcccattgccacaccttgttatgaaagccggaaaaacctccatgattggtattattcccatcattaacttccaaatggaaggttttcctatctattgtaaaagaagcatcagcaatacgattggcaaatctgccaacagttgctcccatataataagaatctttcaaataatcggacaaggtatcataaccgatcaaaatattggctaatgctccctgaacatcgggtactgaagctgtaatccaacgtgccccccaattagtgaattccatataagctcccgaggagttcattacggtaaatcgtaatacaggttttccgtcagaggtataagtttctattttatgtattattttcatattattccaaatttcagaaaaagaaaaagcatcaggtaggaagcagatgtttcctcctgatgcttctaatttatatggatagaaacaatttatttgctatatcccggattctgatcttcagggccgaatgcatcatttgttttaatttcagtatcaggaataggatagcgcttatggaaatcttgaattgttcctgattcttttgcccaacggttacgttcttttatcaattctacaaatttattagtacgaagcaaatcaatacgtctccaaccttcgaaacaaagttcacgcaaacgttcatccattactttatcacggaattcatctttgctcattcccgaattccatttcttatcttctggcaagtttcctccccatgcacgagtacgaatttgattattcacgatctgtactgcttccgaagtctgtcctaattcattcagacattcagcatgcaataataatatatcagcataacgaatcattgaaaagttcttaccagaattccacatgttattaatgccaagccctgaaagaatatctgtacgatagtcttcatatttctttatatgcggttccaattcatctgtagttcccgtccattgagtctttgacaaatcaggagttacatattcgaatgttccatcttctgaatatttattagtataatacgtaaaatcataacgcaatgcttcttctttacgcaaatctccatcttcccaaatgccaccttcttctaccgtcttataagcaaaaggagtcggaactagaaagtcgtaaccagagaaagagcatccctgaccaaaccaagagtcacatgcacgagaaccacaatcaaactcccaataattacaatcaggatatacattattaaattgcaactcaaacaatgactcttttgtattaggattatcataacgatacaagtcagcataattattcagcaattcatatcgccccatattaataatagtcttaaaacattcatcagccttggcaaaatcccgtaatcctgtctcttccggagctgccatataagcctttcctaacatggcccatgcagccccaacagtagcacgctgcggttcactattataagactcaggcaaattattggtagcagtaataaaatcattaataatatattcccatacagtctttaaaggttgacgtcccaagcccaattcatcagtacggttcatatctatcacagggatttcaccccaatacatacttaattcaaacattaataaaccacgaataaagcatgcctctcccatcaactgtttagcacgttccggttcttcagtggtcatacccaatgcatatatagctttagcagctgaaacgacagccggccaacggttgttccaaatagaactaacctgagtagatgtaggattcaactgtccattatatttatccataccggcttgatcgcctgaagaaatcaattgataattaccctgctgtgtttcatctgtccccaaataaggcatcaatccattacgtccttctttacagcccctataactcttatacaatccaagaactaaaggttctacattatctattttttcaaatacttgttcttcagtcaaagatcccgtaggttctacctgcaaaaaatccgagcaagaggaggttttcagtgcaaaggtcaaagccaaagcatatatcgcactatatctatatatctttttcattgttgtgttttcttttaaagttagactatttattctatccttccattaaaaagtcaaattaagaccaaaagtatacatacgtgtaggaggataccaatcaccagtttccggatcataaccattataattagttaagcaaaaaagattagaaccagtggcataaacacgcaggttagtcagtttcagagcatttatcactttagttgggaaagtataggccaatgtcagagcagacaaacgcaagaaagaagctttctgtacactaaaatccatagaacttgcaccataatgattataatcaaagccagccaacacacgtggaaattcagcatctgtattttcaggagtccaacgatccaacaaatccgttgatgcgactccagatccagtacttccaatcaaagtttcataccaaggactcaattttttagccccataagaataactgaatactacatttaaagacaatcccttccaagaaaaatctgtagaaaaaccgccataaaacttaggatcagtggaaccaattacaacacggtcattttgatctatctgtccattattatcataatccaacggatacaaatcaccaggattcacattatatccattccaatttattttattcaaacgatccatatcaatttcttgggcgattccacctgttttccaaatataaattgtgttacgagactcaccaaggaataaattaccttctttttgaatattacgatcactatctacattatatacaacatcattatcaccatataattgagttaccttatttttatccatagacaatgtagctgcaaaattccattcaaaatctttagctcttaccaaattggcattcaaagcaaattccaaacctttgttttcaatcgcacctatattttcaatagtactgctgaaaccagtagtcgtaggcaacgaatggctcattaacaaatccttattttttatcaagaaagcatcaacagacaaacgcactctattctgtaagaaagccatatctactcctaaattccattgtttttgtttctcccaactaatatctggagtaccacgtcgcccattggaaacaaaagaattcgtataacctgtatcggaagtacccgtatagctgacattatataaagataaataggcaaaatcatcaatattctgattaccaacgataccaaaaccagcacgtaactttaactgatcaaaaatcgtctgatttttcatgaacttttcttctgtaatattccaagctgcagacacagacggaaaaataccccactgatttcctttagcaaatttagaagaaccgtcgtaacgcgctgtcgccgtcaataaatatttacccgcatagttatagttaacacgagcgatataagataataatgtttgctcggaccaagctgtacttaagccgcgctgatcttttttataaccagatcccaaactatgatatccaaataaattagtgccaaaccctgttgccgtagcattaatataattatacatagtccgtgtagcactggtaccaaccatcgcattcaacttatgtttaccgaaagaggcttcataagacaatgaattatcccattgccatacagtacgtgtatctctatcatctttggcttcaccttgtgttccataacgttccgactcataaatatcattcggggtatatttattttgctgcttttgagcataatcaatagagaaagtagaacgcaagtttaatccttcaataggattgatattaatataattagagctcaacaagcgattatacaccaaatcattatcgactttcaaagaacgtaatggattaaaattattttggtcaaaaataccttgccaatttaaagtttcaatctcatcagaaatttccaacatcggattagcacaacgtgcacgattcattactccatcatcaaccaacgtgttctcggtacgtgtaaaagttgtattagtacctactttcagccaggatttaatctgttgatccgcattaatacgtcctgtgtatttttcttgttcagacttctcaattacacctttattgtctgtataaccaaaactaatataataagaacctttatcattgccattcgaaagacttactacatgattgtgttgtactccagtacggctcacagcatccagccaatcataatttttattattgttgtaggcatcgaattcataatcagcaaaaacagtattcgatcccattatcacatcattgatataagcattgacatctccatcaggatttgtttgcatataaccattcgtataggcctcctttctaagttcaaataattgacgagtattcatagtttttggagtattagcataggtctgaaagccaatccagccatcataagaaactttaccttcgccttttttacccttcttagttgtaataacaacaacaccgttggaaccacgtgaaccatacagagctgtagctgatgcatctttcaagacctcaatagaagccacatcattcaaattgactgcattaaatccagagaatgaattatccataaccataccatctacgacataaatagggtctgtagatccattaattgtattaataccacgaattttaatagatgcatcatccgtaggacgcgtaggttgagaaatgaacacacctgcgacacgaccttgaagagcttgatttacatttgttactggtttttcttccaatactttagaactaacactggcaacagctcccgtcaaatcactcttcttcatcgcagtgcctacaacaaccacttcatctaatgtttcagtatcctccgacatcacaactttgactggttggttacccattattttaacatcttgtgcaacatatcctatataagaaatatgcaatgtttcccctttctgaactgataatgtaaatttaccatcaaaattggtaatagtcccattggctgtaccttttaccactacacttgcaccaatgataggttcggatgtaacatccaccacctgtcctgtaaccgttatgttctgtgctagcatattgcagcaacaaaacatgataaggattaaattaataagcctaattcttttcataatttgtaaatttaagtacgatttaaagtttatattggtttattcttccactttgaaaattacaacatcacatgcaggaaccgttacttccagattggttttagcagtactttcaatgccactccataattctttcagcctatattcctttgacgaatccaaccccagacgctctaaagctgtagtcatcttcaactcttgatccatatagttgaacacagcataataagccttaccatccttatccatgcgtacaaactgattttctgacttttcaccattcccatctacaggatggaaagattccccattggctatagcattgatctcagcattagtcagatatttcatcgccttctccttcacttctttagaaccgcctttgctgaaatcatctccagcaatgaaaattcctgtaatgacccccgaagtaacacgcgctctgttctcaccatctgtagcatcacgcaatacaatatggtcaggatcattaaactgataaaccttatcctgccaccaaccgtatgaaagtgcattcaaggtatattcagtatccttcatcttattccacgcatcacaagcaattcttctagactgagcataatgagcaggaaaaacaggagaaatagaaagattgatatacatatcgccaaaatatttgtcaagcaattgcattccatagttatatccctgaatacctgtttgtatttccggattataccatttgtcagcctccatcgccccatgtgtcataaaatccattttcacatattcaaaacctgcccgatgaaagagttccgatgtacgcttcatcatagcttcaatagctggatgggtaggatcaacagcatacgctccgtctaattcctgcggttttccatttgcatagagatacacatctttatatttataccccggaatttcttttatttcacgttcaggatttttagcccaatcagtaaacggagtccaataaacgccggctatctgaccgtttgccttacatctatccacaaaagctttcaactcctcttctgaaaaactattccaaccagaatccaaacctgtataaaccagattatccgaattcacaaaatgatgggactgcaaattctctttataaaaatcagaaacttccaatgctttcggataggtcagattaaattgcaacgctccccagctgttccagccaaaaggaacagctttatcccaagctttgggcggagcaatcacagcattagcctgagcgtattcttccatgccttcacgccagtcttcaaaaaatcctactaaaatcttaggcgacttgattgtcgtacctttcaatgcaccgtgaggtttcgaatcacgcgttgtcttatcagcaacacccccataacataccaatgaacctacattatatatattacctttacctattgttatacctgttttccaagaatcgtgttccacagaacctatcaccatagcttcacgatcatcattattaaatatggcagtaacttcataactagtcaattctgtaaatgtgagcggatgagattggtatctgatccaacagtcattatcgaaaggaatgaaaagcgcacgattattttcaccctggttcaggacttcaggcattcggtccacattgaccggcgccatataattcgaagccatttcagacgtactttccaaagtaaaatctgtcaacacataatcctttgtcggatatacataaaaagattgaaccagtacaggcaaattattcccagtataagtcacctcataatgatacccttctccaaaatgatcattgattttttttgtagaaacatgatgctttgcataatcacgagtcgaaacaacactgtcggccaatttataagctgcatatacattatcataaataagcttagagcctttgctgatatcaataccattagcgtgagcatcgtactccaaagaccattcaccgacatttagatttgcattttcagtacacccggacaaaataagaccggaagcactcaatgcagaaacacagagaaacaatgattttaaagttaaccaattattcttcataatattattagtttgtcaaagagataaatctacttaaggtttgctttactgttcggaattcttttcctttcaagcatggtcaaaagtaggcatatcttgacaacctgttaatatacaaacgcagcaataaataggatttttgcagcaatgactcatctgcgtccgaagaatccgcaaatgtgtcattttttgctgcatttctttcaatcagagattctccgtcaaatctattttagctttttccttggatgtttgatactgtttctcaaactctttcggagtcattccgaattgtttcaggaataatttactgaaataagatgaagagtttattcctaccatataacagatatccccaatacggtatttaccttcctgaatcaattcggccgcttttttcaaacggatcaaccgaatgaaatctatgggtgaaagattaaacagaatctttattttcctcaataagctggaacggctcatacataagatatcagccatacgttccacattgaaattttcatctgaaatattctcttgaattacattaattactttattcataaattcttcatccgccttgttcatctgcatattatgcacaggaaaaaaaggacgtttagagaatgcctcacgttcttttctacgattgctgagtaaagacaaaatctgactcttcaaataattgaaagaaaaaggtttctccacataagcttccgctcctatcttcaatccgttaattttactctccaaatcattcttggcggtaaggaaaataaccggaatatgacacaaatcaatatccccctttatttccttacataattcatagccattcatcaccggcatcattatatcactgattaccaaatctatgtgattactacgtaaaacatccaacgcttcctgtccattcacagcagtttccaccgtaaacaaaacttccaatcgttcaaagataaaagatctcatactttcattgtcctctactaacaataaagtataacctttcatctggtctgtttctgttgatgtttcctcatccaatacttctatattttgctccactaccttctctatttgctgccttacttcctctttattcaaaggaatgatcaaaacaaatgtattctccggttgttctatatccaaataaagcctgcctttatgtaaagtggctagcgaacgagctaaaggtaatcctatgcctactcccatccgaactgtatccttcttctccatctgataaaagggttcaaaaatctgttggctggacgcttcaggtatcttttctccgtcactgacaatacgaactgtaaaatcagcttcatcttggaataaatctatcgtaatggtatgacgggcatatttcaaagcattattcaacaaattactcaatacttttgtgatagcctccttatctatggcagccataattctttcttggggaatatgctgcaataactctttctgcttttgcagaatagtaggctcaaaacgagcaatcgtttcattcagcaatgccgttacatcaaccgtttcaaatttcagttcaaatttgctcgcccctattttctgaaaatcaagcaactgtccagtcaaatctaataatctcttggtattctgcccgattactttcaaattcttattcaatttctgatccttgatatccatttcctcaattgcttccaacggaccatttatcaatgtcaagggcgtgcgcacctcatgagctatttcagtaaagaaactgacttttgattcatagagttctttctccttctcaatttcaaataacttctgcttttcttccatctgtttctcttcgcgtcttctataccaaaagaaccagcaaagtacgacacagattccccatataatatacagaaaataagcccagacggactgccaccaaggaggcagaataacaatggataaagaccgggtagcataagggccttctttggcactattggtagcccgcacttgcaagatataatctcccggaggcagtttagcgtaagaaatattctgattactcgctgcccgtatccagtctttgtccaacggaactaatttataataatactgattggactccgtagtagaataacttaataaagcaacatcgaaactaatatttgcctgatcataaggtaatataatttcatctgtatgttctatacactttttcaaaggagaattaggagtgtgaactgttatttcctgattataaatgctgaactttgaaatataaacaggtggtaagaaatttattttctctgaagagttaggatcaaatgcaatcaatccgtctataccaccaaaataaaacttaccgtcctcacccttcaaagctgacttataattaaactgattccctaatagaccatctttagtggtatacacccgtatatcttttgattccggattaaatctaaccagtccacgatttgttccaaaccataaatttgattgttcatcttccaagatcttataagccacatcatctggtaaaccgtctttgatagaaaaagtagtaaaatcatccgtttgagaattataacaacaaataccaccacgatccgtagaaatccaaatacggcctttacaatcctgcatgacagaactcacagaattagagctcaatgtattttccttaccttcctcatgagtatactttttaaaaagattcttatggggatcatacttccataacccacttcccatggaggcgaaccacatcattccatctttatcttgaaatacatcaaaaatccaatcaaatcccacttcttccactttgtcaaaatgaaaacttgtaggagcagctttataaagtccccagcctgtaccaatccacttatatccttcattatctataaaaaaagtataaacacttccttctcctatatttaactcctcaggagtataatgacaaactttattctcgggtaattgaatcacatccaatccttgcttaaacaagccacagaacaattggcttcctttgacaaacattcccaaagtaaccatatagttccctttatcataatcgttcaatctcaaccgccttacctttccggaagcaatatttaatatgttcaccccatcatcttcagtgccaatccatatgttacccttattatcagaagctatctctcttacccgtttcgttgttaatgagttcccatcactcccaggtacatatttatcaaacaataaatcatgatgaggcagataatccaccccgccaaacatggttcccagccaaattcccccttcccgatctcggtaaatagtataaataatcttatctgacaaactgaacggacgcatcagatcttgcttcaaatgaactattttattcttcctctcatttacaacaaacaaaccttcgtgagttcccacccatagttcattgtcaaaacaggctacattacgtacaaatgtatggttagcctccggtatatctatttttaccagctgattcgtaccgggattatatttcattagttccccttcatgaatagccattgcaatccaatcaccataattacaaataaaattaatattctttccctttaacgaacgcccggttttatcaacacaatattgttcaaatttatccgtatttctatcatatcgaaaaagtccgactccccatgtaccaacccaaacatcaccatcagggcgtaccaaaatacaatccggagcttctgttttaaaatgctctttgttggttacttcataaaaataaagcttctcatccttatagcgaaaaactccctgatcaggaattacaatccaaatattcccaatagaatccgccacaatattagatacccaattattcatattcaccccttcttctgtttccatattcattgccgtgaatatatccaaggcaggattataacgatagactcctctatccgttcctacccataactgacgttccttatcttcaaacaaagcagaaatattatggtttcccgtaccggctacatagtcatcacagttcatctgtacaatagaagttccatcaaaacggttcaaaccattttttgtaccaaaccacataaacccgtaactatcctgaatgatagccttcacattactttgtgatagtccattctcacccgttatatgagaaaaataaaaattggacaatcccctatcaactgcctgtaatgtaaatacaacatacaaacaacataaaatgagcaaagtctttttcatagcttgttcaaaatttgagtcaaagataaaagaaaaaaaggataaataatgccaatataaaagaaatagagggttgcccctctatttcttttcacgaatgactattacaaatcccccaccagaagccataaacatttcaataatattcttattatctatatccattattttatgttcgtataaattagcattcttgttacttctttttttatcctgaaaaatttcaatggtatatttcttatcctgaggcaggaaagagcaatccacctgaattgttctctctccccaagcattcaatccgcctatataccaagtatttcctttctgcttggccaacacggcatattcgcccacacgggcagctaagggaatcgtctgatcccatgaagtcggtacttccgctaaatactttaaaatatcaggatacttacgatactcatccggagaatcacataaactggcaaatggtgcggaaagtacaacaaacaaggccaattcatgtgaacgagtccccaatgaactaggcaaccccggatcgatcggcttaaatttctccaatgtgctgttacgcatcgaacccggagtataatcaattccacctcccagcatacgggcaaagatacattgaagctgataatccggattagaagtggtatcccacttaaaacattccgcacatcgcatggcttcataagaaaggatattaggatatgcccgatgaagtccggtaggcttgctgcatccatgaaaatccaccataagatgccgctcagcacaagcctttgccagattttcatattgagggattatttgggcatcatcacgatcaaaaaaatctatttttaccccaacagcaccccatttgctgatagaatccaaataacaatgcggatgttggaataaagtagcagcaacagtccaaagccatacacctacttttttttcttttccatagcgtatcacctcttttatatcaatattcttattcaaatcagcatgattaaaaacattgctccaaccggcatcgaccagcagataaggtatcttgttttcggaagcgaaatcaatataatacttgtacatctgcgtcgaaaggttttgatgaccggaagggaaaggagctttttccaaaatagcacaatgccaccattcccaagttgctttaccaggacgaatccaatccgtatcctttatttgttggggcttggccagtaagtaaatcatttcattagtcagtagttccttatcatccttggctacaatagctatacgccaagggaaagcatgattaccagcagtacgtgctaaataattctccctctctttaactaccgtaataaaatttccccaactgcccatctctatttttttaggataggccgcccaataacctttcatcttgccatcttccttacgaagatacatacccggatagttattcaaatctgattcagccaccacaacacgcacattctgcatcttgtttgtaaataaagttggtgtaataccatatttatgttcttctattttagaaatgccctcgtaaagcacattgctcaactcccaagctgtaaaattagttgtttcgggtaaaataactgccggatcatcgcccagattaaaagaagcttcttcatcagctacaatcaaagaatcctgctccggaagatttccacaaaaacgatatgccattccttcattatacatccggaatataactgaataaccatccttgaatttcaaagaaagttcattataatggtctgttaattcacgatagttaccagctaccggataaaccttctcggaagtactccttgtagaagctcctaccacttcaccattctttccccatatatttccattttccatcgtcatacaaatagcagagggatgaatgacaggcttaccttccaaacttaaagaatattgtaatacccttccattctctacagtaagtgccaattgcccgtttggggatgataattcataagctgacggtgtttgtgcctgtgcaaaaacacacagacaccatgttaccaacaaaaggaaaatattcttttttttcatacggcacacaagttacgatggatttgtccaccttgatgattaatatccaattctcgcaccttatccaaaaaatcaatggcttttcccatttcacgcaatcctaaacaacccagtcccatcacataattgcaatgaatgcggttacgtttatccaagtcatcttcccaaatagccaaatcaggcagagaaacagcaaaataatcaatccggcagtggtcaaataaatgcttttcaccatgctttatcaatttgttaaagcaaccgcacgccttgtcttccctgcccaatgcacgccatgccaaaccttgatagaaaatcttgtcgggctgttggtcattgtaaaagaaagcctgttgtggttctgacgagccaatggttgctttgatgaagcaatctatagcttgttgctcatttcccaatccacgaagcgcctcacctttataataccagatatcattctcttcagcatttgccaattttccctcacccaaattaaatggataaacattcgtttcatccaaaaggactaaagcatcggcataacgtttttcacttaaagcaatctttgctaattctatacggcacaatacatattgtccggtgatttttccttctcctccttcccatggatggaaattacgtgcggcaatcaattcttttgcttcagtatagcgccctagttgattatacaaagtgatacgctcaatggacagatcatcacgctgttccacttcagacagatgtgcttccaaaaaagccaaacgttctgtatgaggtcggcctaaacgtttataaagttggtccaactccattaatatacgagaatcgtgctcatccaatgcataagctttttccagagtttccaaagccctttgtttatcattacgcttattataataagctaaagataaattacgccatacggtagggaatgttggctctatagcagccgaatgttcccaacaagcaatagcattatcatactgacggttagcataccaaaagtttcctaaactatatgccgcttttgctccatgaatattcaaacgtacggcatcttgaagaatcaatacttcttctatacgattcgggaaacaatatgaatgattttccttttctgctcgctgataatattccaatgctttactctcatctcccttacaggtatggaaataccccattgtataataaacgacaggatatacttctgtaactccggttacgtagcattccaacaaagaaagagcttcctcgtacagtccggcagcagcaaaatccaatgcatattctatatatccgtgagcccagccacgcatcaactttttcatttcctccaacacttccacatcccgggtcaacaaataatgttcaaaacggcatcccatattaaaacgatctatctgcaatgattcggctacgagcgccaaagcttcctctttacgacccaatttgcgtagaatggaaattttcaactgacgcgctttgtgattatgccaattacgaatcaatgaacggtctatcttgtccaaagcactttcatactttcctttacgagtgtcaagttgtgctagtgcataataagccgcatcctgccaagcagcattccatgccgacttaaagaaagcatcataagcctcatcccatttctgttgcatcatacaactccaaccccaattataataaggttcaccgtcataaggattcggattacgttcagtcaaggtttccaccgctttccggaaatagctctccgccattgcaaattgtcctttacgcatcaacaataaccctaccgcattgttacaacgtacatctcccggttcacgtcttaatgcttccatataataatccatcggattataagtagcatggcgatattgttccaaatgtagtccggtcaaaaacagttgttcgacagaagcaatatcttgaggatctttagcagctttagcaggatcaggaaccggcttgatttccggcttatccgcttgataagaaagcaaaatttgtccttccttatcacgaacctctacacatacctcctcttcttttagtccttctgccgcaaaagtcgtaataaacggttctgatggcgaaatttgtgtagtcttatccaataaaacagtgcctttaatagcttttactataatacgtactccactattcactcccgtagtataaagcaccaaacgggctttaccttcctttatttccaaattcagcaaagcatctttagttgcattctttacataacccacttcactataaggcataaaatactgtacccatgatttttcctcatagggctgtaaccaagtaaagtccggttggttatccgtatacataccggtcatcagctcaatgtaaggtccatcctcatcggtcagattgcgatcccacgccttaccgaaatcaccattcccccatgtccattgtttctttcccggagaaacatgatgatcggccacatgcagcagaccgccatgggcatcttcttcataaccacctacaaaatcatatttagacttgatagccatatatgatgtaggaaccggaatatttttatatttagagatatccaccccagcagaataatcctgtttataataaactcctgtagcaataggaaaagaagaaacatcgcgcttgccatgatcgaacaccgcattcacatcaggtggaaataccgaatgataatggtcattgactactactgcaggattggcccaccacaaaaaagtctgagggaaagacgtacgattataaatcttcacttttatttctatataagctttgcccggataaagcgtaaatccctgcatacctttggtgcggaacattctctccacttcattgcaccatactgtcttactgccatccgcattttcctctatcaaaaaatcagtaggcaaaaaagtagaaggacggtgatgctgaggccagttaaattcgatgcctccagaaatccaaggtcctgtcaatcccaccaatgccggtttcactacttgattgtaataaacaaaatgacgtcttttcaccttatcataagccatgtgtatacgaccacccagctcgggaagtatcatcaccttgatgtattcattctcgataaataatgcatgatacctcttgtctacttttttatctgaaatcttctctaccaccggataaggatagactgatccgcaacttccctgataaacccttttttcaagaaaaataggattcttctcttcctttcctatctcataagtaggaagcatgatatcttcctcccatgcacgcacctcactgccatgaacggtactttgaattaaatattgagttattttctccataataaatattgttatttcactaattctttttcaatttcttccaagctcttccctttggtttccggcaaacggaacacaacaaatattcctccagccaggcaaatcaatccatacaaccagaatgttccggcagctcccaaaccactattcagcattgggaaagtataggtaagtataaaacaagccgcccacaaagcgaaagtgcaaacagacatagcaactccacgaatacgattcgggaaaatctctgagataatgacccacatcactgtagccaaagtcatggcataacaagcaatggccatcacgacaataatcaatagaacaactcctgtgatatgaaaataataagcggctcccataaaggtataaattactgccaagccaaatgatccgatcaatgtcaatgccttacgtccccagcggtctaccacaaacatagctagaatagtaaatatgacattcgtaataccggtcaccacaatattcatcaaaacatcagacacgccataacctgctgccataaatatttcctgtgcatagttaaaaataacattaatgccacaccattgctgcaaaatagccataacaacacctatagtcaacactttatacatagcaggatttaataattgacggtagcctccttcttgcgtctggcaggctgaagcagcttctatagcagccaactcagtaacagcatattcctttcctcccatacgagtaaaaaccttgagtgccgcctcccgttttcccgaagaggctaaccaacgaggactttccggtaatataaaactaaaaacaaagaacaaggcggccgggacagtcattgcccaaaacatccagcgccatcccatctgtccgttccatgattcacggatcatttcatgagtagctcctaatgccacaggctcagctatctgccaatttacaatctgagaagtcaagatacctaatactaccgtcaactgattgatggacacaaaccgtccacgcagatgcgccggagcaatttctgctatatacataggtgacaaactagaagcaatccctatagcaaagccccctaccaaacgaaatacattaaagaaagtaaaagaatgaacagcccctgtaccgacagccgtacagataaacagtcctgccgccaaaatcaaaatcggcttacgtcccaaacggtcactcagcttaccggcacttagtgccccaaacaaacagccaatcaaggcactgctcattgcccacccctgcatgacaggatcatttgctataccaaagtattgttcataaaaaggttttgctcctccgattaccacccagtcatatccaaacaggaaacctcccatagcagaaatcaaagcgataagaaatagataaaaattagattgtgttttcatgaatatcatatattagttagttttataatgcaaagtaacaaggattcaaggacttaaagaatagaaaaaattactgagaacatggacaatattactatttcatcactttgcaggttgtcttatcataaaacgaggactacacctcaatatactaagatgtaatcctcaatcaagctatgcaaagtagcctgtttttttacaataactccagcaaatctccacgtttcatatccaccgttattaaaccctttgcatcaggatttgcaattgcctccttaccatttaaaagcactctatattttttcccttgaggaattttcacttttaaaacctgatcagcagtagcttttaaagaagctttattgatgacagcattcgtccattcagcagttgcttcagctcctccctttaaacacagacctttaaaactaccatctttccattcaacaggcaaacagggtaagaattctacataaccctcatgattctgtatgagcatttctgccataccagctgtaccggcgggattcccatcaaacgaataaatatcaccttccgcaccagcaatgccaccaggagatacagtcattaaattttcacgtgaaagcttgccctgtaataattggacactcttatatgcttcctgcgcatctttcaaccgagcatacatacaaatcatattggcacggctccattctgtatcttcccagttttcggcagacaaacgattctcgatagtcttacgggcagcttccgccaattcgggagtcttctccaaagtgatctgggaaaaaggatacaaagctagcagatgggaagtatgacgatgattgggatgcgcttcttcaaaatcttcaaaccactcacggatagcaccattggcacgtaactggataggaggaagctgggcgatagcggtacgcaggctatcggcaaactcacggtctgtatctaatatttctgaagcccggacacaattcgacaagatctcgtaggccagctcacggtcacaggcaggcatcatggaagcaaccatttcttcaccacctgctgtacggaaccagttttcgggtgagatgctcggccctgtcatcagataaccactcttcgggtcttttgccaagaaatccaaaatgaactgtgcattacctttcaaaagcggataggcagtttcggccaggtattgcttatcttgtgtaaattcgtattgtatccaaagatgagaagcaatccatgagcctgccataggaaacagtccccaaataatcgtgctggatgcgggagtatatccccaaacattagcggtggtatgggcagtccagcctttacatccgtaaaccacttcagcagtcttcgcaccgtgatgagctaaatcctttatataggtaaagaggggggcattacattcggcaagattaccgacattggctgcccaataattctgttcagtattgatatccaaatgataatcattcgtccaccccatattacaagccttgttatcattaaagaaaccttgcaaagctatgggcaggggagagttctcgcgcgaactggcaatggtaaggtaacgaccatactggaagaacaaggcatccagtccggtatcggtcttgccttccttcacttgtttccaacggacatccgtaggcatcgcccggttagcgtcttgcccgaaatggatagaaacacgattgtacaacgtattataatcctttatatgcgcctgcttcaattcatcataagatttagctgcagccttctccacaccgtcagcacaaagagtcttgtaatcaggacttttataatccgtacgcacatcgacaatcaaagtcacggcatcagcttctttgatacttaccccagactgttccatctttacctctccgttatcggccaaaacggctattcttccttcaaaacagactccgcccggaccatgcaaaggaaaatctacttttccggtaaacaccaattggttattttctacagaaagatcagcttgacgcatcaaatccaatcccatgttcatagtaatggacttttgcttatcagcggtcaagcggagtacgagaacattatccgggtttgtagcaaaatactcacgtttatagttcacaccaccggagttgaaagaaacgctgctgacagcctcatccaagcttaacgaacggcggtagtcggtcactttaccttcggggtaaatgaattgcatcttcaaatctccaatgggaagatgagttccgaaagaagtctggttgccatgaagattatctccggctatacggtttccttccgatagttttccctcaaaaaacaactttctgagctggtccattttctcccgtccgaaaggtttgttctggttctcattgtactggccggaccacattgtcgattcattcaatgccagtttctcttcctctattccaccataagtcatagctcccaaacgcccattaccgataggtaaagattccatccaaacttttgccggttgggcataccacaattctgtagtttcacaggaatcagttgcactctggcatccggaaagggccaaagccattgctgctaaataagtcttaaaatgtttcatatttttcatgattaatagtttcttctgaaacaaaagtagatatacctctcccattaggtagagaaaaactcgccatttttagactcttttgcttcaatcgtaacctataaaagggagttattcaacatttagaaatctttcccggcacaaattccaacacttcaccatttgttatcattttcccggtgaggcagtcataacaaactccaatattccgcccttcatgatatcctgatgagtaatataattcttcgtatatttttcaccattcagtttcatggaacagatataaacctcattgtcctccttacgcggagcttttaccgtaaaagtctttctatcgggtaactgaatgacagcttcttccaacataggagtaccaataacgtactccccacttaccggatttaccggataaaagccaagtgctccaaacacataccaagcagacatctctccacaatcatcatttccggcataacctgaagaagaatcgttatacagttcattcatgatatacgccacgtatttctgtgttttccaaggttcccccgcacaagcatacagataagccacatgatgactcggttcattaccatgcgcatactgtcctacaaaaccggaagcattgtcattcaatgcaccactttggtagctaaccgtaaagaatgtatccaactttgcgacaaaggctttgttcccccctgtcagtgaaatcaaatcggggatattctggggtacataccaaaagtattgccaagcattcccttcagtaaaaggataacctccattcgccccatacttataagggtcaaatggctcaatccactcacccttatcattcttaggctggaagaacccggttttagaattgaacaaattccgatagaaagcagatcgtttcataaaatgattataatccttttcttttcccaatcgcttagccaactgtgcgacacaccaatcatcaaaagcctgctccaaagtaatagaaacagattgtgtctgaatattctccggcatatatccatatttctcccatacttcaaaaggagagttcggatgagacacgatagaactattaaaaaccgcttcataggctttctcttcatccaccccggcaacacccttcagaacagcatccacaatgacaggaatggagtggttgccaatcatacaataattatcctgtccccataattgccatacaggcaaatagccataataatcgtattgcctcatcatgctcttaacaaaatcgggaatgcggtgcgtgtgtatcaaagtataaagtggatgggcggccctgaaagtatcccataaagaaaaagtagaataatgcacctccccttttgccacagaacgagtgacgtaatcggatgccatatattcaccattaacatcactcatcgtattgggttgtaccatagtgtgatataaagccgtataaaaaatctttttctgcaaatcggtaccttgaatgataatcttcttcaattctttctcccaactagtttcggcagcacgagcaatatattcaaagtcccatccggggacctcagttgccatattcaaccgggcattttcaatggaaaccggagataaagcgactttacatatcaattctttattccacttcttatcgaagcaaaacaatccacgcagttccgtaccattaatgacaggagtattctcatacatccgattgccatcatataactgattggataggaccggttgggaaaattcaagatgaaaataaatctttctcagctttgcccatcccgtaataatacgatatccctctactacggtaggagaaaccatgcggagttgtgattgaataatccggcggttccaactccccttatttgccgagtggtccaaatccaaccataatttcaactggtcaccatcagaacaggtatagcgatgcactcctacgtgtacagaagccgtcaactccgcttgaatcttctcatctttcaataatacctgataatagcccggacgcgcctgttcgtgttgatgagtgaaagtcgatttccttttatcactgatggtagggaatagaagtatatctataaaatcagaagcaccggttccgcttaaacgcgtatgactgaaaccataaataatagaatcattataatcatatcctgaagcttgcgcccaatcaggagcttcacgagtgtcgggactcaactgcaccataccaaaaggaacagtagctcccggataattattcccagaaagactagattgaacagcaccggttccaataaacggattaacccaacgagtaagattctgggcgctaatacaatttacagaaagaataaaagcagccaataaattaacaagtcttttcatcatagatttaagtttcatttattggcaaaattagtatatccacgctccccaaacagataaattttcgtctattttagcttcatttgcttcataaagtccggtttcttagcctcatcaccacaaaatattacaattatcccgttttattccaattcatttaccgccaacaaggactactctaacattttccaaataaaacttataaattcgggaatgttaccccaattatcatattttttttcacctatttttctatatttgtgcattattccatcacacaaacgtaaagacaaatggaccaaaccttgctaaaatactggaaaacctgccttcaagatgcagaacgcaaagccattgctcccaaaggagcacgaatcaccttaaacatcggtgataaaatacttaaattcgttcctctcaaaagtattcctgttattttccctgattggaaagcagaagatagcaatgaaaaacaaaaagtaatgattgctccttgtattcttttgcccgaatttgaaaacggctggacttcccaatcagaaagaccggaatatccctttttgattactgccaccatgttgcctgacggtaaactaaccgtatgcgagaacgaatcagacagaattccaatctttattcgtaaatttttggaacccaatgcagccaatgaccgcaccataacctctcttccaaaagtagaccgactactatccgatttcaatacagaaattacagaatgggaaacctattggcgagcatgcgaacagcttttcaaaaaagcaaccggcaaaactttcagaacgatgaactaccatgataatccagaaatcattatcataaaagcctccgaacgtaatatggcacagcccataatcacactatatgacaagctcttaaaagataacgataccactccgcatcctttgttgaatttattgatacagaccaaaccaaccaacgttcttcccagtccaaccacccgaaaagtttattgcaaccgagaacattgggcacaaatgagtggcgacttccctttgtctgtatctcaacgcgaaacactggcaatgtatactacaccggaatgtactgatatttttgtcgtcaacggccctccgggaacaggaaaaaccactttcctgcaaacagtcatagcaaacagacttgcccataatatcctaaacaatccggaagaaccggaaattatagttgcaagttcagctaataatcaggcgatcaccaatatcctgaaagatttcaaagcggaaacaactaatgacacggcacatccccggttatccaaccgctggctacccgaactagatacgttaggcttatatctgtcaggaaaaaaagaactacaagaacaatacaaaatgatgttcaaccccatgggggatggatttccagcaacatacgatactcccgaacgtcaagaggaatacaaaaacttttatctacaatgtttcaataacttttttggaaaagcctatcaagatgaaacaaaatgccaacaattcctccgtaaggaaatgcaagctctccaaaaaaagattatcttctgtatccaagctgccgaaacaacagaatatggaaaccggaaggaaaacaatatattacagaagtttatccgcaaattccatgagccattaccctcctatgacaaagtaatagaacagtgggctttgacagaagaattcaaagaacgttacgaaaagatcagttccaaccctgagtatggcaacttgccttatacagaagacatggcagtaagactggatatcagttatcggtatcaaatgttctggtatgccatacattatcgggaagccgagtttattcaccggttaagcaagtgcgatgaaggtaaacagcgtacacaggaagcctatacccaaagattaaaacgtctggcttgtgtaatgcctgttttcatctctactttccactccctacccaagtatatgacctatgcggagaacggaaaatgggatgttcccttatacaatggaatagacctgctgattgtagacgaatccggacaagtttcacccgaacttgccgttccctccttcagtttggccaaacaagcgattttagtaggcgatattcaacaaatagaacccgtatggtccatttctgatgaatattcattcattaatttaaagaatctgggcattgtttccaaccagtcctcggaaaaataccgtttcttggagaacaacggtttcctttcttcttccggaagtataatgaaactggcacgtaaaagctgtaattttacagtaaaaggtgaaaaaggagcttttctgaccgaacacagacgatgcgtagattccattattgcttattgcaatgattatgtttaccacggcaggttacttcctaaaaaaggtaacgaagtaaaatacaagtccctcccctctaaaggatatgtacacatcaacagttacagcagtcccggaaaaacaggaagccgcctcaaccgggctgaagcggaagccattgtctgttggctggagctggagaaagataatttggaaaagacctataaaaagcctattcataaaattgtagccgtagtaactccttttaaagcccaagaggccgagatacggcatcaaatacaaaaaatatcgggaaatgagaaatataaagagatgattatcggcacagtacattccttgcaaggcgcccaatgtccgattgttcttttttcaacagtcaactctcctgaagaccattctctttttatggagcgtgatggaaaatacaatatgctcaatgtagcgatatcacgcgcccagcatcatttcattgtttttggcaacatgaatattttccatccggaagaaaatactccggcagggaatatggctaaatggcttttcgatgctccatccaacgagatttccaacaactttatttaccaacaggaaatcccactgtgcacctaccaccccacccttcgtctgtccaccacagaagagcatgttcagactcttcgtcaagcttttgagaaagcaagacgccgcctgctgattgtatctccattcatatctatccatgccatagaaaacgaccagctgattccgttgatacggcatacggttcaacgaggagttgatgtcacaatctacaccgattcgtccctagattatgatatgaaaaataaacatttactcagtcatgccaaggatggacggaacgcattgatagaaagtggtgtaaccctcattgaagtaaaaggtatccacaataaatcgttggctattgataaccatacattaatcgaaggctctttcaactggttgtctgccaatcgccacaaagaatactcccgccacgaatgttccatcattgtatcatcttttcaagccgatgaatacatcaacaatctaataaaggaactagaaagcagagagaaaacctttcaatccctatctaagactacaatctatcttgacattgaccaaaaacatccggggttctttacaaaagaatcttttaatgattgtacagaagaagatatttgccgtataaaacaaaaagtccaaaagttaggtattcagaaaacagtccttccaccttatatccgtaaacaacgtgaaactttcccacgtgcttatgaaccttggtgcacagaagaaaaggaaattatatgtgagttgatgcagaaaaccaatcatctttctatttttatagaatgtctgcaacgtacaggacaagcaattcaaattcagatagaaggcaaaaacaattgattataatcctgaactgatatcctttttatgatattcgggaaacttgggaaacaagaatcagtccctatacagaagagaggaaaaggcaaaaagtaatttgccttttcctctcttctgtatagcatatgcaactcctgtcagagttcctcattttttggaacacatccaggtccatttatgccaaatactctctaacggtccctgcttgtgtcctttcaaccaccacttgcaaaactgtacttgcaacaaaaagagtacaaaaccaataaacaagctcaacgtatacccacaatacggagccagataaagtccgaagggaaaataaataatagctccggcaatagactgggtgatataattagtcagactcatcttgccataataacgaagatttgatacaaaatccttgaatctgttccgttgataaagcaacacaaaagaggcaaccagcacaaatgtaaaagcaaacttctgccacatatcaaaagccgttccggcagtctggcgaatgagctcactgtcactagccataatcagctctttcagttggaaaagcggagcaaaagcgatagcggaaatgataagagccttcacccaaaaacgagtatgtttttcggaagttacaaataattgtttgcgtccgatatacaaccccatcaagaacaagccggcagtctgccagaaacgtcctgctccaaaagcccaatataaactggctttctgaccaaaggtcatattcttacccaaaaactcccacaagttcccctctttggtatattccgccacttctttatacatcgcgcccactccccaatcgggcaaagtatgagaaggatcaaacagacctactatataatgataccactcaacgggctgcaatagaaacaaaatagctgtaacaagtatggcacagtcactccacttacgcaccacgaacaatacgattcccactactgagaacagcaacaacacatctcctgccggaaaaaaagctgcattcagcgtagcaaaagctaccaataacagcaaacgccacagaaaacgataaccaaaatcttttcctttacgctgctggttagccgactgaatataaaatgtaaatccaaacagcaaagcaaaaatggcatacgattttccagccaataaagtaaatgtaacattgaataccccgtcattcagtatattcagccatgcaggctggtctaccggataaaccggaaagatgaaatgttccaaactatgcactaaaagaattgccatgactgcaaatccccgtaaagcatccaccacctcaacgcgtggcagtttttctgataattgtttttccatgaaccagttattattgtttgtttaaaattcgttttacccagcggttagccggtttctcaaaataataataagaaagcaggctcagcccgatagtgactgcaaagataagcggaatactgatatacagactgatatgccaatcgtatgtttgcgccaactgcacataagcaaacagtatccacaaatgaatcagataaaagctataactgatatcaccgcctatgaccagatatttattggatagaatacgggaaaggaatcctttctgcaaagagaatatcaacagaactaacgaaatcggcatccaataatagcaggagtaccgatacactttcggcaccaaatccgctgaaatcatgtaaaacagcaggaagatacataccgcccctacttcgagcaatgacgctgtaaagaaagacagctttttggaacggcaccattcataaacccgataaagcaacattcctaccagaaaatcggggaaacgtgccaatggattcacataccaataaccgcggatgttcgcctcatccgtcattgacatcaaaacaggaactaccacagcgcatactaaaagcgctcctatcaatttctgttttttagcaaaaagcaacgctaaaaacggaaacaagaaataaaacaactgctcacaccccaaactccaggaaggactgtcgaaataaaagaagtaatccatccggggaacaaaagggtgcaaaaggaacagcgcaggaataaaatgtttcaatccttccccccaacccatcgggttcaatagattacctatcacggccactcccaataaggtcgctatatgcaatggatagatacgggcgattcgtgccacccaaaactggcgtttcgacactttccgctccaccagcttctgctgataattataagcgataataaaaccactcaatataaagaaaaaactcacgcctacaaaaccctctttatagaaatgagttgaaaaggtggaatcaacgacatagcaatgtgccccgaaaaccatcagtgcaaaaaagagccgtaaggaagttaatgtattaatcatagtagcattcttttctcaattgaatgtaaaggtacatttcttttccgaactatttattcacatagaacggaaaaacagattggaccgcattattcaccaataaataaaaatatcatccaataaccttatatcacgaacgggcttatatcacgcaacaaaatcatatctttcacagaagcgacgtattgtttttctgactcgacagtgggcaagttgtacaattcgggcaaaccgcctttctgtaaataggtcaaataagaagcccggccggcaagttgctgcatcaactgtaaatattcagcataactatagggcaatatatgaaattccacataacgtccccacaaaattgccaatcttgtcggtataagctttccgttccagtcccaattgatacgtatttccgccccaaaggttatacttttctaaagctttccatttatcgtccatgctcgaatcttttcccacaaagatagtttttttcgattatactcggaaaaacatatctatctcaaactgaattaaagaaaacgaatacaatccggcagtatgtaaaatttaacaaattacttaaacaagcaaactattattttcctacatttgttaccagtgaaactttaaatacgaaagaacatgaaagcaaatcctgtatttagtttgtacatccctaccaaattagtatttggttgcggagaaatcaagaaattatccagtgaaaaattaccggggaaaaaggcactagtcgtcatctcatccggaacttccatgcggaaatatgggtatctggaaagagtactcgcccaattaagactgaataatgtagaaacactggtttacgataaaatccttcccaaccccatcaaagaacacgtcatggaagcagccgccatctgccgggaagaaaaatgtgactttgtagtaggcctgggaggcggaagttccatcgactccgccaaaagtatagctgttatggcctgcaacgacggtgactactgggattatgtatcagggggtagtggcaaaggacgccccgtaaccaaagcacttcccattatcgccatccctaccaccgccggaaccggaacggaaatggatccatggacagtgattacccacgaaacggctcaagaaaagataggcttcggttgccagctgaccttccctaccttatctattgtagacccggaactgatggtttccattcccccgcacctcaccgcctatcaagggttcgatgcattcttccatgccgcagaaggttttatcgccaattgtgcaacacccatcagtgatctttatgccttagaagccattcgtttgatctacaaatatctgccagtagctgtagccgacggaaagaatttgaaagcgcgtgccaaaattgcttgggccagcaccttggcaggcatggtggaggccacttccagttgtacttctgaacattcattagaacatgccatgagtgcttattatccacaacttcctcatggagcaggactcattgccttgtctgagacatacttcgaaactttccggcatgactgtacaaaacgttacatgaaaatggctgaaatgatgacccagaaaaagagcaaccgtccgtccgatttcattgatgcattgattacactgcaaaaagaatgtaaagtacattctatcaaactgagcgagtttggcatccaatccgaagatttccccaaatttctgcaaaatgcaagagatacgatgggaggactgttcactctcgacccacgcccgattacagacgaagaaatcctgcatatctttaaaaagtcttataaataatggataaagaactagaccttgccgtaacctgttacggcaaggtaaaaccattgaaatatgatttggtcctcctcccttggggggctaccgaaccgcataatctgcacctgccttatctgacagactgtattctgagccacgacatcgcactagatgctgctaaaatggcaaaaacacattacggtattcgttgcatggtcctgccttacgtcactgccggttcacagaatccgggacaacgcgggctggatttctgcatccactatcgctatgaaacgcagaaagcgattttaagcgacatagttgcctctctatacgcccaaggataccgcaaaatggtcattatcaacggacatggcggcaatacattcaaaagtatgatacgtgacttgtcactggactatcccgacttcctgatagccagcagcgaatggtttgcctttgttcctgctaaagagtactttgatgaaccgggtgaccatgcagatgaattggaaacttctgttatgatgcattatcatccggaattggtaaatttagacgaagccggaaacggagattataagaagttcacctcacaaatgttgaatgaaaaagtggcatggattccgaggaactggcaaaaagtttcgcaagacaccggtataggcaatcctaaaaaagcaagtgccggaaaagggaagaaatacgccgaagcagtcgttgcaaaatatgcattgctgtttgaagagttggtacataaagaactttattaatagttttagaactaaataggtttattttcttcataataaaaagcataaatttagcacatcatataagtcacattcaattatatcactgcatataaaccagttacccaacaatatattctgaaaaatattccaaaatatatttgatataataaaattctaatgtacatttgtgaagttaactatatactaacctttaaaagcagatcttatgaaaaacaaatcactttttttagtcctagtcattctttgtttgactagcgtagagatctattcttcccgacaagaattaaagtttgatgcacctcttccgagcaacacagaaaacggaaatgctcgcagtgattacggacctcccggtgaaggagataaatgctggtatttcgatggagcgtcttcttgtgtaaatttttcattcaataattgttatgaagacccaaaccaaaggtgcggaagagatgaaggagctcccaattaatttaaccgactagcaaatcattccatagggtatttaagatctttcctattcataattagttgatccaatctacaaactgaagataattaaataccctatatttaatctatagtgtatgaaatattttttgtatatcttcacttatctacttctaggagcatcgtgttcatctccttctcgtccaatagactatggtacagaattaacagctacagactccatctgcctgtctatagatgaacatacacattatgaaagcaaatctatattccaatttgaagaaaacggacatgagtatctttcctttttgaatgaaaaagcaagctataaagttcatatctatgatttggataccaaacaagttattaaaacaattcatctacaaaaagaggggagaaatgcaatgccatcaactaatggctgttttccacttagctcaaagcattttttaattacaacttggaatggagtttttggaattatcaatgaaaaaggagaagtggaaaataagaatagcttttggaaagacagcgtaaactttcatgctttcgaccacatttgttgcatgagttatacatatcgacctgccataattaaggattctattttatatttcagtcaatcattattaaaatatccccgtaaaaaagatgaatgggataaaatacccatatttgcttatgcagaccttcataaaaaaaaactagggtggacagaactacgatacccatctatttttaacaaagatgagatagactacattctgtatgaccctgaaatcagttacacatatacaggtaaagaagttgttgtttcactgggacaatatgacagcatatttgtatcttctgatttcaaacataaaaaagcgtataatgctaaaagccattatctgccccacgtgcgtccagtctcccaaaatttacaaattgatttattcaaaaccatacatgacagaggattacagccccattaccaccacttgatgtatgataaataccgaaaagtattctatcggtttgccttaatgccggatgataatataaaaccattctccaacaatccgcatcaaagtttctccatcatcattctaaacaaagactatgaaattattggtgaaacaaaatttcccggcaacacctatgcccatcacttgtgcttcgtaggtaaaaaaggcctgtatatttcagagaataatgaaaataatcctcagtttgacgaaaacaaactggtattcaggtgtttcacacttcaaggccggaaaaaatgaagaaaaagaactactcaatcattctatgtggaggactgttcctggcaagctgtatgtccaataatgacaaatgccttcaaaaactgtttgatgaagtcggagttgagaaatcacaaatccacaatgccacccaccttgttaccatattgggtaatggttgcaaaggatgcatacacaaagctctgtcagaaatacataactcgaccgatactatttatataattgcatgtaaaagtaaaaagactttcaatttaattgccaataaaaatatagatgactactccaatgtatatctagacactaaatccatattagtggaattggatatggctaaaaacacacctagagtctaccttttaaataatggtaaatatgtgtcgcactctttttatggaaatgaatctcccagcgaagaagcgaacaccaccattacattcaacacaaatgagatagatttaggcaaaatcagccgcacggaaaaggcaagaatcaaattcacaatatggaatacagggaagaacatagtaagaatcagtcatatagatctttcatgcgaatgtttgaatattgaaaatgaaattactgaaataaatccgggagacagcacttgtctgaatatcattttccatcccgatgacataggaaagtttcaaagagaaattttattatatggtaattttgactcatctcccaaacttttaaccattacaggagaatgcttttaataaaataatacaatctcgctataaataactttttagctatttatagcgagtataccatccatttctacccttttgaaagttcctccaacgttttttcctcgtacctgcaaatggcctccttataatcctcggaaatcaatttcggttctttggtagccaggtcataacctaccatcaccgtgcggcactcacacttcacctcatgggtatccgtagtcacggcacgctgcaacaaagtaaaactcttatgccccaaatgtaccacagccgtttctatcaccagatgatccgagaaaaataccggcataaagaagtttgcattgatattggccaccacaatagccagcttactccagtcggcactgccaaacacatcttttatataagtagtctttgccaaatcatacaaagaaaagtaaactgaattgttcatatgaccaaactggtccacatcgctgaatcgtatctgcaccggcatagtatgcctgaattttatatcctctgccatagttaagcttattaaaatcgttcaaatataacacttttctcaataattgaaccctaaatgacagattattcttaattttgctgcgaaataaatgaatatgtaattttaataacaatataaacatggataagaagtatagcagggagaccttatgcgtacaggcaggctggactccgaaaaaaggcgaaccgcgcgttttgcctatttatcaaagtaccacattcaagtatgacaccagcgaacagatggcgcgtctgttcgatctggaagattcgggatatttctatacacgcttgcaaaaccccaccaatgacgccgtcgccgcaaaaatcgcagcattggaaggtggtgtgggtgctatgctgacctcgtccggccaggctgccaacttctatgccattttcaatatctgtcaggcaggcgaccacttcgtatgctcgtctaccatctacggaggtacattcaacctgttcggcgtcacgctgaaaaaactgggcatcgagtgtaccttcattgacgccaatgcatccgaagaggaaatagaccaagctttccgcccgaataccaaagcgttgttcggcgaaaccatctccaatccgagcatcgatgtgctggacatcgaaaagttcgcacgcatcgcacacaagcacggtgtgcctttgattgtggacaacaccttcgccactcccatcaattgccgcccgtttgaatggggagcggatatcgtcacccattctacaaccaaatacatggacggtcatgccaccagtgtaggaggcgccattgtggacagcggcaactttgactgggaagcccatgcggacaaattccccggtctgacccagcccgacgaatcttatcacggactgacttataccaaagcattcggcaaaatggcttacatgacgaaagcaaccgcccaactgatgcgtgacctcggctccatccagtctccgcaaaatgcgttcctgctgaatctgggattggaaacattacacctgcgcgtgccccgtcattgcgaaaacgcacagaaagtggccgaatggctggaagccaacccgaaagtgaaatgggtgaactattgcggactgaaaagcagcaaatactatgatctggcacagaaatatatgccaaacggctcgtgcggtgtcatcgctttcggcttgaacggaacccgtgaggaagcgatagaatttatggacaggctgaaattcatctgcatcgtaacccatgtggccgacgcacggacctgcgtactgcatcccgccagccatactcaccgccagctcaccgacgaacagttgcgcgaagcgggagtcgctccggacttgattcgtctttcagtgggcatcgagaatgtaaacgacatcatagccgacattgagcaagctttacaataagacgaagcggatgaaaagaatcattatcattggcgccacttccggcatcggactggaagtggcgcgatgctatctgaaagacggctggcaagtaggcgtggcaggacgtagagaagaagaactggaaaaaatccggttatccgcgcccggacaggtatgtactcagacaatagatgtcacccgtgaggacgcccctttctcattggagcaactgattactaaaatgggaggtatggatgtgttcctgctcagctcgggcataggcaaacaaaatctttcacttcaacccgatatagaattacaaaccgccgccaccaatgtttcgggattcatacggatggtcaatgccgcctatcactattttgagcaacacgggaaagggcatatagccgtaatcagctccatagcaggcaccaaagggctgggatccgccccagcttattcagctaccaagcggtttcagaacacgtacatagatgcattggaccaattggcacacatgaagaaactaaacatctccttcaccgatatccgtcccggatttgtcgccactcctttgctgaaagatgataaatatccgctgctgatgcatacttcccaagtggcatctcaaattgtaaaagccatctcccgaaggaaaagagtagccatcatagactggcgctatcagcttatcgtattcttctggaaattgattcccggatggttatgggtgaggctgcctgtgcggaaccaataatccccagccaatatcatttcataagaaaaaccccttgttctcatcttgaacttgcgaaagatttgtaaacaaggcgagggtttcttcattctactccccgaaattacctgaatgaaaggaattggttaaagggaccggcaaagcctgtgatcatgctgatgaaagatcaaacaggctattgaatgatgctttctttgtaaagctgaacctctttacaaacatagaaacttaaaaaaattcttttccctttgtaacaactttcccacttcccccgtctatctgattgaaagcgctttcaaaaaacaatttcagtatgaacaaaaacaaaatagaaccatgaaaaagtttgtatttactctattgctagtcttcgtctgccatctgggctacgcccaaggcatcaacggtcttttcaatgaattcggcagcgaaaaaaatgccgattgtgtcaaagtatcttctttcatgatgtctcttggaaaaatgtttgccggacacgatgaagacgctgagataataagaaaaataaagtcaataaaagtactggacctggaatcttgtacggcaagcgtaaaagaacggttcaacaaaaaagtgaacaaactgaatctgaaaggatatgatgagctgatgcgtgtaaacgatgaaggcgagaaagtccgcgtgctgatgaaaacaaaaaaggaaactatccgtgaactgctgtttgtatgcaccggaaaagaagactgtacactggtacagataaacggaaaattcacaaaggatgatatagacaaattagtaaatcaggaaacaggaaagaagcatggacgccgctgagtttaagcaacaatttctaccttaccaccggaaactctaccgggtagccttccggctgacgggcaaccctcagaatgcggaagatatggtgcaggaagcgtatctgaaattgtggaacaagcgcgatgaactggcggacgtactgaacaccgaagcctattgtgtcaccctcatcaagaatctgtgctacgacgtcctgcgccggagtcagccggatgaagacggacgccctcccgaagagctgaacctccccatggacaccaacatagcccgggaaatagaacagcgggatgaagtgaaccaggtaaaacggctcatcggcagactgcccgagcaacaaaaacgggtgattctgcttcgtgatgtcaatgattgctcctttgaggagatagagcaagccaccggactgaatgccatcaacatacgtgtgttgctgagccgcgcccgcaaaaagatacgtgaacaatataatgcaataatgaactatgaaagtaaatgaaatagaaagactattggcccggtattacgatggagaaaccagcgataccgaagaaaaggaactgaaacgcttttttaccgaagaggacgttccggctcatttacttgccgagaaggaaatcttcatgcaactggcagcacatcccgctcccgaaataccggaaggcctggaaagcaggctgagccgcaagatagacgaatgggacacaggcgaaagacgcacgctgaaaataaaaaaacatatacgggccctccgcttgcaatggataggaagcatagccgccagcctgctcatcctgctctccgtaggactgtacctatacaagccctatccggcaccgcaagatacctgcgccacccccgaagaagcatacgcacaggcccagaaggcacttatcatgctttccagcagcctgaataaaggaatagaaaaggtggaatcggtgcaggaagctaccggaaaaattcaagagaacgtaaacgaacaattaaaccgattaaataacataaaacaatgaaacgtacatatatcattactttattgctctctctgtgctcactgttcacctacgcacaggacagttttttcgacaagttcgctgatatggaaggggtaacctctgtctatatctcaaaagccatgctcagcctgatgcccaacatgaaaacggaaggggtaaatataggcgaagtagcctccaaactggataacatccagattctaagttgtgaaaaacccgacattatcgccaagctgaaaaaggagacagctttcatcagccccaagaacggctacgaggagttgatgcgcataaacgatgaaggcgagaaaaccatcatttatctgaaacggaacaaaaacaaagaaaaggaatttgtattgatgagtcaggaaaaaaatgaatttaccatcatcgccatcacaggaaatctgactctgcaagagatacaagggatcatcaacaaggagtaactccacacataccccaccctaaggccttttctcccgcctgctaaggtctgaagaaaggatatatactatctccatagcactatggagttatctccaaagcttgcggagttaactccaaaggctatggagataactccgcaggttttggagatagtaaccggacggcctgaaaggcttaacaatagggctgagaacgcttacgttgtctccggcaaagggttatccgcccgcagagaccctgccagtcaaggaacttatttctttatccgtttttgggtaggcaaagtaaactcatgcgcttcggtcaccgccccgttgctctctgttgcaaaaacacggaattgcgcctggcctgttttcaacttcctgcctccgcgaatggtggccgtataccttatctgattcccgacaggcatataggctatctgagccgaaggtgaaatcaaaatatgtttcatgccgctcatttcctctatcaccggagtaacattgtaagcgggcacatccccatcattcaccacatcgaacaccagtttgctgtcttcttccgcatcaataacatggttacggttatcatcgataaaacgcaggttgatgatcctcaatcctgacgaaggctcataagaggaagtatgctcatactgcgaagaagaaggataagtcttcacgtaatactcctccacctgataagttttctcccgaggcgtagttatggcatttcccacagcagcccccgttacagttcccagcagggcgccgaattgcgaaccgttatatccgccggccctgtcacccacaatagcgcctaatactccgccgatggccgcaccggcttgtactgccgccggattaccttgcattccggatggtgagcaagccgaaagcaaagcggtcggaatgcataaaatgaatatcatttttctcataccccaagtagtttataatctttatcagacagacaaatatactttttcctattgacaatggattcatcggctatgttaaaatttcatttcctgtcattcatcctcatcggtctaactgccatcattccggatggaaggctcttcttcctaaaatgaaaagataagtctaaataacacaagaaacagaaggagacgtttttttttctatatatttgccgggaaacaaatgaaaagttcttcgccatacccttgcatcgccgcagaaggcttcccccctctccgcagcaaaaccgcacccggtatggcaaggaaatatttacaacctatcattatggaattgaaagcaaaatacgaacagcgcattgaacaggctgaggcagaactccgccaggtaaaaaataagattctccgcatcagcacgctgagggtcttgttatttgcagcagggattataggaacaatctacttctatcaggcaggaacaaccactatatgtctcactatagcggtcactttcgttccttttctggcattggtgaagtatcacaaccggttgtttttccgcaaagactggctggaaacctgcatacgggtgaatagtgacgagctttccgcactggcggacaactatgagccttttgaggacggaaaggaatttacaaacccggcccacaggtattcttttgacctggacttgttcggaaggcactctttgtttcaggccttgaaccgtacctgcacttcattcggaaaggaaaaactggcagaatggttacaaaatcatctggagataaaggaagagataatccaacggcaggaggcgacaaaggaactggctgcttattccgatttccgggaaacattccggattaccggtctgctctacaaaggggcgacaagcgaccgcgaagaaattaaagagtggacggaagcacctgcttatttcagcaagaaatggtggagccgcccgttattgggaatagttcccggagtcaacatcgtactggctatgctgggagtggccggggtcattccgatgacatggttcggactggccttcggactgttcgtgataggtagtttcggactgataaagcctgtcagcaatctgcaaagagtttatgacaagaaattacgtatcctgtctatctacgccgaactgatcagcctgatagagaaccgggaaatgaacgctccgctactcagacacctgaaagctgaattcggcatggacgggaaatccaccacccatattttgaaagagctttcacgggaactggacaaactggacttgcgcaacaaccaattgttatatgtcttgctagaaggttccatgttctggcaactccggcaggtaatgcgcattgaacaatggaggcacaaatatggaaaatatctgcttcactggctggacgtcctgggtgacattgatgctctttgttcgctggcgacatttgccggcaaccatcccgcatacgcctatccggccattgccggcaagccttttgttttccttgcaaaggatatgggacatcccctgatgcctgcacggcaatgtgtgaccaatgatgccgatatcccctcaagaccgttctttgtcatcatcacaggagccaacatggcagggaaaagtacttatctgcgtacgatcggagtgaattatgtattggcatgtaccggctgccctgtatgctgttcctcccttgaaatatatcctgccaaactagtgacaagcttgcggacttccgattcgttgacagacaacgaatcttacttctttgccgaactaaaacgattgaaacaaattatagaccgcctgaataagggagaggagttgttcatcattctggatgagattttaaaaggaactaactcgatggacaagcagaaaggctcattcgccctggtacgccaactgatggaactgaaaacgaacggtatcattgccacacacgacctgctattagggaaattaatagaatatttccccaaagagatacggaattattgctttgaagctgatatcaccaatgatgaactgactttttcatacaaactccgtgaaggtatcgcacaaaatatgaacgcttgcttcctgatgaaaaagatggggctaatcatcaacgactaaccccacccaacaatttatcacattaacgtcttaagcaaataaagcagaccttcacaggcacaccttatttcataacataaagagtcatagaaaatcaaaattcacttgtttccaagcaatgtacaaacgcacttgcatcgtctcccgtgaaataaaacacagaagatgcaggctcgtatgtataggggatgaaacggaacaactgggccgcaacgaatttcttatcctgagaaatcatatagtccatacgtacgtttccgtttgtctttactttcacgtcattcttggtttcaaaaccttttttctccaacgtttccgttaaagcctgtaaatcgcatacatcaaagaagcaggctccttctttagctacactgccggtaggtgcatatacccattccttgcttcgccagaaaaggcggaatacggcccacagaaacaaaatggttccaccagccataaacaccatactcatggtggatgaggaatcccccatctttaaagaggttgcaaatgcacctgcacctatcacgcaaaggatagcggatatgataacagaagaaatactagtacgttttacgacatcaggatgtgttgttgaaaataaggtcgcttcagtagaaactgtattactcataataatttaaattttattctttactaattaaaaagacaataattcataccaaggtcacatctcgccatcaccgacaagacggaaccatgaaaaaacaaattggtaaaagaataaaagctaaatgagaatacgcctcataccgaagatatagtgctcgcaagcactatcccaatgaagggagtgggaagaggcatacacatgggtatgacagcttgcaagactggccatccgggcggccatcttacgcaacaaagtctttataaattgggtagtctctatggaggaaaaacggtacatacgctctgcagaagcactgacacgatgtgctaaagtatgagcatccccaaactccatatctgctattcccttattgctatccatgggaatgacactatcctcattgatggagtcctgcggagtagtatccgtattctgtacagtacataccgtcattaacgcagctggaactgcatcaacatattctgttctggcaaaagccaaagcaaacagaaaaaataatatgactgttacaaatcctctcattgcttactgtttgagttacaaagataacataaatagcttcttaggtttcatttcatacaataattaacaaatatcaaaggtattttgttttaaaggagatttgaaggattatcaaaagatatgaaggatcagctctcaactccttcatgatttctttttgagatacaggcagttatctatccatgaaggttttgaaggaattattcagtgttcttaattccggctttaatctaaaagctgttctcgttctgtatgcttcgttcatatcaaaacttttgtaaacaggacaagtaatatttatgtggacgaaagcgctctcagcttgttttctcattactgccgatcatggcataaaataaaaaaaagccacagcttttatagctatggcttttatatatatgatgatatacagattattcagctttaggggcttcctctgtagtttcagctgccgatgctgcaggagcttctgtagcagctgcactcttcttagaacgacgagtacgagttgctttcttagcagttgcagtcttagccatgttttcatcgtaatctaccaattcgataaagcacatttcagcattatcacccaaacgatgacctgttttgatgatacgagtgtaaccacccggacgatctgctacttttacagagatttctttgaacaactccgttacagcaaacttatcttgcaagttgctaaatacaacacgacgtgaattagttgtgtcgtctttagattttgtaattaaaggctcaacgaatttcttcaaagctttagcctttgcaacagtcgtagtgattcttttgtgcttgatcaaagaacaagccatgttagataacatagcacttctatgagaagcagtacgacctaaatgattgaatttcttattatgtctcattttttattctttatctaatttatatttagagatatcggtcccaaacgacagattcagaccctcgagcaaatcatcaagctccgtgagcgatttcttaccgaagtttctgaacttcaacagatctgtcttgttgaactgtaccaagtcacccaatgtttccacatcggcagctttcaagcagttcaaggcacgaactgagaggtccatatcaacaagcttagtcttaagcagctggcgcatgtgcaatacttcttcatcaaattcttcattgccgtccacatcggatgtttcaagagtaatcttttcatcagagaacaacatgaaatgataaatcaatattttagcggcttctttcaaagcttccttcgggtgaatggaaccatcggtagtaatttccaataccagcttttcgtagtcagtcttctgttcaacacggaagttttccacctgatatttgacattacgtatcggtgtgtaaatagaatcgataggaattacattaacatcggtacaatattcgcggttttcgtcggccggaacataccctctacctttattaatagtaatgtccatctgcattgttgcttttgaatctaaatggcaaataaccaattcaggatttaacacttcaaatccagtcaaatacttacttatatcacctgccttaaattcactagaattctcaacggtaatgcttaccttttcattttcgaactcttctactacttgcttaaatctgacttgcttcagatttaagataatgttggtcacgtcttctttaacaccaggtacagatgcgaactcatgttctacaccttcgatcttaatcgtattgattgcaaatccttccaatgaagaaagaagaatacggcgtaaagcattacctacggtaataccgaaaccgggttcgagtggacggaactcaaattttccaaatctggagtccgcttccaacattaatactttatcaggtttttgaaatgctaatatcgccatgaaattaattattatttagagtacaattcaacgatcaagtgttctttaatgttttcaggaatgtctgctctttcaggtatatgtaacaacttacctaccttagaactttcatcccactccaaccaaggatatttgctatgattgaatcctgcaagtgaattagcaatcacttccaaagatttagatctttcgcgtacacccacaatctgaccgggttttacagagaatgaaggaatattaactacctttccatctactgtaatgtgcttgtgacttactaactgacgggcagcagcacgagtcggagcaatacccaaacggaacaccacgttgtcaagacgagcctctaaactctgcaacaagatttcaccggtaataccgttagcacttgcagccttttcaaacaggttacggaattgtttttccaacacaccgtaagtatatttagctttttgtttttctgccaacatgacaccatactcagaagtctttcttcttctgttgttaccatgttgtccgggaggataattcttcttagataaaactttatctgctccaaagattccttcaccgaatttacgggcaattcttgattttggtccagtatatctagccatttctttttctaatttaattgttactaatgaacttaatttgttgcagccgcgattacagaaaggaagtgcaatccattattaacaaaatcaagttacatataaaaataggttatctattaaactcttcttcttttcggaggacgacaaccgttgtgtggaagcggagttacatcaataatttcagtaacctcgataccagctccgtgaacagttctgatagcagactcacgtccgtttccaggaccctttacataagctttaacctttctcaggccaagatcaaacgctactttagcgcaatcttgtgcagccatctgtgctgcataaggagtgttcttcttagaacctctaaatcccatcttacctgcagaagaccatgagataatctgaccttcactatttgccaaagatacaatgatgttgttgaatgaagaatgaacatgcaactgtccattagcgtcaaccttcacatttctcttcttagctgcgactgttttttttgccatatcaacaattattatttagtagcttttttcttatttgcaactgttttctttcttcccttacgtgtacgagcgttgttcttagtgctctggccacgaaccggcagaccaatacggtgacgtacaccacgatagcaaccaatatccattaatcgcttaatgtttaattgcacttctgaacgaagatcaccttctactttgtattcagcaccaatgatttcacgaattctagcagcctggtcatctgtccagtctttcactttcacatctctgtcaacaccagccttatccaagatttttgctgaactactgcgtccaataccatatacataggttaacgcaatctcgcctctcttattctgaggcaaatctacaccaactattcttatagccatatactaaattattttttttgcaaaaataataaattatccttgacgttgtttatacttaggatttttcttgttaataacatacaaacggccatttcgtctaacgattttgcattccggcgtacgtttctttaatgatgctcttactttcatatcttatttcttttttatttgtatctaaaaacgattcttcctttagataagtcataaggagacatctctactctgaccttatccccgggtaatattttaatgtaatgcattctcatcttgccagagatatgagcagtaatctcatgcccgttttctagctcaacacgaaacattgcattagacaatgcttcaactataactccatcttgttctattgcggattgctttgccatattaaattgctttatctcctaatacttgttcgacatattcaaatgaggacaaaatatctgccttcccaactcctattgcaactgtatgctcaaagtgagcggcacatttcctatcgcgtgtacgcactgtccatccatctctttccattactatttggcgggaacccaatgttatcatcggttcgatggcaatgcacataccctttttcaacagagtgccatatcctctttttccataattgggtacctgcggatcttcatgcatatcttttccaatgccatgacctacaaattctcttaccacaccataggaattagcctcgcaatgttgctggacagcaaaacctatatcacccaaacgctttccatgaatggcattctctatacctaaatataaagcttcttttgttgtcttcaaaagtttcaagacctcaggatcaacttctcctacacagaaagtataagctgaatccccacaaaaaccattcatataagtaccacaatcaacagaaacaatatcaccttctttcaaaggggtatcattgggaataccgtgtacaacctgatcatttaccgaagtacacaaggtactggggaagggatcaccatactgatttggaaaacctttaaaagtaggaacagctccattatctctaataaactcttcggccaccttgtcaagttccttagttgtcacaccgggttttatcaatttagcaacttcagccagagtcctacctacaagtaggttactctgacgaagcagctctatctcatcatctgtcttaagaaatatcatctcagactaattaatatgcagcaacattaccagcacgccccttgattcttccagaatttaacaatccgtcataatggcgcatcaacaaatgactttctacctgttggagtgtatccaatacaacacctacaagaatcaataaggatgtaccaccgaagaactgggcgaactcagcttttactccaaaaatgccagcaaatgcaggcataatggctacaagagccaagaatatagaacccggcagagtaatacgagacataatcgcatctatatactcagctgtattcttacctggttttattcccggaataaaaccattatttctcttcatatcttctgccatctggttaggattaattgttattgcagtatagaagtatgtaaacacaataatcaatattgcaaaaacaaaattataccagaagctagtatgatctacaaatgcacgtacaataccacttgcggttgcagcatttgagaaacctaccaatgtaatagggataaacatgattgcctgggcaaagatgataggcattacattcgcagcattcacctttaaaggaatatattgtcttgcaccaccatattgtttgtttcctacaatacgttttgcatattgcacgggaactttgcggacgccttgaaccagcaaaattgctgctgcaataacgaacaacaaaaatactatttccaacaaaaacatgatgataccacctgcacccggagaagccaaacgagaaacgaactcctggaataaagattgtggcagacgggcaataatacctatcaaaatgatgaatgatataccattacctatccctttatctgttattctttctccaagccacagaataaacatacttccagctgccaaaatgatggtagaagtaattataaagaatgtccaatctaatgaagcattaagtgatggtccggcttgcatcttaaggttaagcaagtatgagggagcttggaaaaccaaaattgcaattgtcaatatacgggtatactgattgatttttcttctaccactttcaccttcacgctggattttctgaaagtagggaacagcaatcgccaaaagctgaattacaattgatgccgagatatatggcatgattcccaatgcaaaaatagatgcattagaaaacgctcctccagagaacatgtttaacaaggctaacaaaccttcactcgtttgtttatgcaactgagttaacatagcagggttaatacctggcagaaccacgtaagaaccaaacctgtaaattgcaacaaataatatagtaatgaggatcctttgtctcagatcctcaattttccatatattctttaatgtttcaatagattttctcattgaatcagagttttactgcattaccaccaacagcttcgattgcagctaccgcactctttgaaaaagcattagcttccacatcaagcttagtagtcaaactaccgttacctagtacttttaccaattgattagaagaaatgaaaccagcttcaataaagtcattcatacctaccttagtcagattcttagcttcagccaatttctgaatagtttcaaggttaatagctttatattctacacggttaatattcttaaaaccaaacttcggaacacgacgttgaagaggcatctgtccgccttcaaaaccaatcttctttgaataacctgatcttgatttagcacctttatgacctcttgtagaagtaccacccaaaccagatccggggccacggccaattctttttctagtctttgtagatccttctgcaggttttaaattacttaaattcatatcgtaattagtttttttattaacaatgaattacttaacgatggcaaccaggtgttttaccttttcaaccattcccagaatagaaggagtttcttcgtgctcaaccacacgattcatcttgcgaagtcccagcgcatcgagtactcttttttgatcagcaggagcaccaattctactttttatttgtttaatcttaatagttgacataattcctccttatcctctaaatactttttccatacttacgcctctgttctgagcaaccatacgggcatctctcatctcacccaaagctaaaatagtagcttttaccaagttgtgcggattagaagaaccttttgacttagccaaaacatctgtaatacccacactttccaaaacagcacgcatcgcaccacctgctaccacaccagtaccggtagaagccggcttgatgaatacttcagcgccgccaaatttagccgactgttcatgaggaactgtacctttcaatacaggaacacgagtcaagttctttttagctgcttcaacgcctttagcaatagcagctgttacttcacctgctttaccaaggccccaaccaataataccgtcttcgtttccaacaacgacaattgcagaaaagctgaatgttctaccaccctttgttacctttgtaacacggttgatagcaaccaatctgtcttttaactctatatcgttagttatcttaactctattattaactgccataattgattaaaatttaagtccaccgttacgagcagcgtcagctacttcttttattctcccatgatacaagtaaccattacggtcgaatacgacagtcgtaataccagcttcctgagctttcttagcaatcagttcaccaactttagcagcctgttctttcttaggcatagcttccattcccaaagatgaagctgcagccaaagttctaccagacaagtcatcgataacttgaacgtaaatctgcttgttacttctaaacacactcatacgcggacgttcagtagtacctgaaatcttattgcgtactctatatttgatcttgattcgtctttctaattttgttgtcatgataatacaattttatgtaaattatttagcaccggctgacttaccagactttctacgaatttcttcgccaacaaacttaatacctttacctttataaggttccggcttacggaaagaacgtatttttgagcaaacctgaccaagcagttgtttgtcacaagattccaatataataagagggttcttatttctttctgacttagtttctaccttgatttcaggaggcaactgcataaagatattatgagtataacccaaagcgaaatcaataatattaccattgtttgaagcacggtaacctacaccgacaagttccagttctttcttataaccttcagaaacaccaataaccatgttgttaaccaaagaacgatacaagccgtgaaaagcatgtctttgttttatgttatccaacatctcgttttcgttttctgtcaacatcacatgtccatcttcaattgcaacattgatagaaggatcaacaaattggctaagttcgcctttaggaccttttacagtaactacattatccttcagagtaactgttactccagtgggaatactaatgggtaattttcctattcttgacattgcttatcctcctattaatatacataacaaagaacttcaccaccaattttcagttcagcagcttctttgttagtcattacacctttggaagtagatattatagcaatacctaaaccattaataactctcggcatgtctttgtaacccgtatacttacgtaaacccggagtggaaactctaataagtttcttaatagcatttactttgtttactgagtcgtacttcaaagccactttgatagttccttgaggaccatcttctacaaacttgtagttcagaatgtagcctttgtcgaaaaggatcttagtgatttcctttttcaaatttgaggcaggcacttctactactctgtgctttgcactaattgcatttctcaatctggtgagataatctgcgattggatctgtcatataataataaattaaattaatcaggactaccctgacaatatttaaaaataaaaagaattaccagcttgctttcttaacgcccgggatcaaaccattagaagccatttcgcggaactgaattcttgaaatcccgaactgacgaatatagcctttaggacgaccggtcaatttacaacggttgtgcaaacgaataggattagcattcttaggaatagcctgtaatttctgagcagcttcaaaagcttcagcaggatcacctgagttgacaatctttttcaacgcagcacgtttttcagcatatttggctacaagtttggctctttttacttcacgagccttcattgattcttttgccataatatattaatctttttttgagtttttaaacggtaaaccaaattccttcaacaaagcataaccttcttcatctgtcggagcagaagttacaaaggtaatattcattccgagaattttagtaatactatcgatatttatttcagggaaaatgatttgttcctgaatacccaatgtataattacctcttccatcgaacttactttcgatacctttaaagtcacgaatacgtggcaaagcaacacgaacaagtttttcaaggaactcatacattctttcacgacgcaaagtcaccattacgccaatcggcattttcttacgcaacttaaagttagcgatatctttacgtgaaactgttgcaacagctttctgacccgtaattgctgttaactcattaatagcaacttcaataatcttcttgtcagcaacagccatacccaatccttgattaataacaatcttcttaagtacggggatctgcattgttgaagaatattggaactgattcttcaatgcaggcgcaatgcgctctgcatattctttcttaaggctagcagtattactcattatttaatctcctctcctgattttttagcataacgaacaaatgttctaccatcagaactttctcttcttcccacacgtgttggcttgcctgttttaggatcaaccacattcaagtttgagatatgtatagcagcttcctgcttcacgataccaccctgagggttctttgcattaggtttggtacttttcgataccatattgataccttctacaagtgcacgtccttctttaacaagaactttcagcacacggccagttttacctttatcttcaccagagtttacgtaaactgtatcgcctttttttatatgtaatttactcattacttaaatcttttacaaaattaaagtacttcaggtgcaagtgataccactttcatgtttgcagcacgcaattctcttgcaacagggccaaaaatacgacttcctctaatttcacctgcattattcaacaatacgcaagcattatcatcaaaacgaatataagaaccatcagcacgacggatttctttcttagtacgtacaattaaagcctttgatactgcaccttttttaacatcactagaggggattacactcttgatagaaactacaatgacatcccctacagaagcgtaacgtctctttgtaccacctaatacgcggatacaaagagcttctttagcgccactgttgtcacacactgtaagtctggattctacttgtatcataattacttagctctttcaattatttcaaccaatctccatctcttagttttgctcaaaggacgagtttccatgatgtgtactgtatcacctacattacattcattcttttcatcatgagcatggtattttttcgttttagaaacgaatttaccataaatagggtgtttttctttaaacttagcagcaacagtaatggtcttatccatcttattgcttactacaacacctgttctttcttttcttaaatttctagcttccatgaggaccattattatttgttaagttctctctgatgcaattctgccttcatacgcgcaatcgttctgcgtaactttttaatctgtgcaggattatccagcggagagatagaatgatttaaaaccatctgattgtaattggctacttcagcttcaattctttctgccaattcattggtagctatttctctaatttctgcaatcttcataataaattaagcattttgattttgagcatcgtaatcacgtctaactataaacttagtagtaacaggaagcttctgtgctgcaagacgcaaagcttctttagctacctcataaggaacaccttctgcctcgataataatacgtcccggggtaaccggagcaacgaaaccttcaggagcacctttacctttacccatacgcacatcagcaggcttgcgagtaataggtttgtccgggaaaatacggatccaaatctgtccttgacgttgcatatatcttgttaccgcaatacgtgcagcttcaatttgtctacctgtaatccatttagtctccaaagatttaataccaaatgatccaaaagccaattggtttcctctttgagcatttcctttctgactgcccttctgctgtcttctgaattttgtctttttcggttgtaacataattcctaaaattcaaatccgttagcgattgtttttctttcttttgaagttcttaccaccgttattgttgccgtttccaccgcgaccgctttctttagtctgagtaaagttgggcgctaattctctcttaccatacacttcaccacggcaaatccatactttaatacccagcaaaccaactttagtcaaagcttctgcatgacagtagtcaatatctgcacggaaagtatgcaacggagttcttccttctttatacatttcagaacgagccatttctgctccattcaaacgtcctgaaatcaacactttgataccctcagcgcccatacgcattgtgttagcgatagccatcttgatggcacggcggtaggcaatcttaccttctacctgacgagcgatattattagctacaataacagcatccaactcaggtctcttcacctcaaagatattgatctgaatatctttgtccgtgattttcttcaactcttctttcagtttgtcaacttcctgaccacctttaccaatgataatacctggacgcgctgtacaaactgtgattgtcaccaatttcagtgtacgttctataacaattcttgaaacgctggcttttgcaagtctggcattcaaatatttacggattttgctgtcttccaacaaagcatcaccataatcattgccaccgtaccaattagaatcccatcctctgataattcctaaacggttgcttatcggattaactttctgtcccatctagtcttaattttgattatcattagtactcttagaatcaacgaacaaagtcacgtgatttgaacgtttacgaattctgtaacctcttccctgcggagccggacgcattcttttcagtgttgcaccaccatcaacataaatctttgttacaaacaattcgccactttctgccttacgttcgtttttctgttcccagttagcaatagcagagcgcaacagtttttccactcttgcagaagcttctttagaagaaaacttcaagacacccagtgcacggttcacttccataccacgaatcatgtcagccacgagacgcattttccgcggagaggtaggaacattttgcaattttgcaaaatacatggtcttaagggcttcttttcttttttcagccgatattttttttcttgctcccattatttattactttattatttcttcagattatcctgcttattttttcttattacctgcatggccgcggaatgtacgtgtcggtgcaaattcacccaatttgtgtcctaccatgttttctgtaacgtaaacaggaataaatttatttccgttatgaactgcaactgtgtgccctacaaaatcaggcgagatcattgaagctctagcccaagtcttaacgacaaccttcttgccgctttcattcatagcaagcactttcttttcaagtttaacgttaatatatggacctttttttaatgaacgactcataatttactcaattaatcagttattactttcttctctcaataatatacttagaagactgtttcttcggagctcttgtcttcaagcccttagcatacaagcctgtacgtgatcttgggtgacctcctgaagcacgtccttcaccaccacccatcgggtgatcaacaggattcataacaacaccacggttgcgaggacgacgccccatccaacgagtacgacctgccttaccggaagactccaatccatgatcagagttaccaacgctaccaatagtagccttacaagcactaagtatttgtcttacctcacctgaaggcaatttaatcacacaatacttgccttctcttgaagttaactgagcaaaattaccagctgatctcaccaaagctgcaccttgacccggacgcaattcaatattatgaattacagtaccaacggggatgttttcaagcggaagtgcgttaccaatctcaggcgctgcattcgctccagacatcaatgtgctaccaacttgcaatccattaggagcaataatatatctcttttcaccatcagcataaaacagcaaagcaatacgagccgaacgattcggatcgtattctatagttttaacaactgcgggtacaccgtctttgtttctcttgaaatcgataagtctgtattttctcttgtgaccaccgcccatatagcgcattgtcattttaccaacgttgttgcgaccacctgttgagcgctttccaaatacaagagacttttctggtaccgatgcagtaatctcttcaaaagtaccaataattttatgtctttgccccggtgttgtgggcttaaatttacgtactgccatctttattaaatattgctataaaaatcaatagtatcgccttctttcaatgttacgatagctttcttataagcattcgtacgaccattgatgattccagacttagtgtaacggcttttactctttcccgagtatcttagcgtatttacatctactactgtaacattatacaaagcttcaatctcactcttaatttccaacttgttagcttcaggacgtacaataaaaccgaatcgatttaacttctcggtaattgcagtcattttctcagtaaccaacggtttaataataattcccattatctaagcctcctttttaaattaagataagatattctcgatagccttgagcgagttttctgtaacaacaagagtttcagcattcaatacattgtaagtatttaatgcagaagcaattgccacattagcacgttcgatgttacgagctgacaaatatacatttttattagcttccggcaaaacgagaagcaactttttgtcagtaattttaagattatttaccatagaaacgaaatccttagtttttggagcttcaaatgtaaagtcttcaacaataatgattgcgttttcttgagctttataagacaatgccgacttgcgggccaatgtcttaacttttttattcaacttaaaccaatagtcacgaggtttaggaccaaatacgcgagcaccacccaccaataccggagagttgatatcaccacgacgagcaccgccaccacctttctgacgacctaatttacgagtagaaccgctgatttcgcttctttctttagatttatgagttccctgacgttggttagccataaactgcttaacgtccaaatagatagcgtggtcattgggttcaattccgaagatagattcgtttaacgtaacctttcttccggtgtcttcacctttaatatttaatacgttaacttccattatttctcaattattacgattgaacctttgcaacccggtaccgaacctttaatcaaaagaagattgtgttccggaatcacttttaatacctgtaagttatgtgtagtaacgcggtcaccacccatttggccacccatacgcattcctttgaatacttttgcagggtaagaacatgcaccgatagaacccggcttacgagcgcggttgtgctgaccatgagtagtctgacctaccccaccaaatccatgtcttttaactacaccttggaagcccttacctttagaagtaccaacaacgtcaacataagctgcatcattgaataattccactgtaatagtgtctcccaaattcaattctgtttcaaaatctttgaactcggccaagtgtctcttcggagttacaccagcttttttaaagtgccccatcaaaggtttggtagtatgtttttcctttttgtcctggaaacctacctgaacagccgcatagccgtctttctcaacactcttaatctgagtaactacacaaggaccagcttcgataacagtgcatggtacatttttaccatcagcactgaaaacggatgtcattccgattttctttcctaataatcctggcatttcagttaatttttaaatgcattaaactttaatttctacttcaactccactcggtaattctaacttcatcagagcgtctactgtcttagctgttgagctatagatgtcgattaatctcttgtaagaagacaattcaaactgttcacgtgacttcttgttaacgaaagtcgaacggtttaccgtgaaaatacgcttgtgtgtaggcaatggaataggaccgctaacaatagcacctgttgccttcactgttctaacgatcttttcagcagacttgtctaccaagttgtgatcgtaagatttcagtttaattctaattttttgactcattagattttaaattaaaaatgattaaatataaagtggggccggattaagagtcattcgctaacccgttgcccctgcttttttattatactaagtctacgcgacctttcacttcttcaagtacagctttagcaatagagctggaaacttgagcatgatgatcgtaagtcatagatgatgttgcacgacctgaagtaatagtacgcaaagctgttacataaccaaacatttctgccaaaggcactttagcttttacaatacgagctccagaacggcttgattccataccttcgacttgcccacgacgcttattcaagtcaccaataacatcacccatgttttcttcaggagttacgacctccagtttcataataggctcagtcaatacaggacctgctttagcacatgcatttttgtaggcttgaatagcacagatttcgaatgacaactggtcagagtcaaccggatggaatgaaccatccttcaaaactactttcagtgaatcaagcggatagccagccaatacaccattcttcattgcagtctggaaacctttctgaactgatgggataaattccttaggaacattacctcccttcacttcatcaataaactgcaaaccgccttgtgtaaagtcttcgtcaaccggaccgattgtcacaatgatatcggcaaacttaccacgaccaccagactgtttcttataaacttcacgcaattcaacagtcttagtgatagcttccttataattaacctgaggtttaccttggttacattctactttaaactcacgtttcagacgatcgataataatatccaaatgaagctcacccataccggaaataatagtctgtccagactgttcgtcagtcttaacagtaaatgtcgggtcttcttcagctaatttagccaagccgttagacaacttgtccaaatctttctgagtcttaggttcaaccgcaataccaattacaggatcagggaactccattgattccaacacaatcggtgcatcttcatcacacaacgtatcacctgtacggatatccttgaaaccaacaccggcaccaatatcaccagctccaatcacctctacaggattctgtttgtttgagtgcatttggaacaaacgtgacacacgttcttttttacctgaacgagtgttatagatatatgaaccagcctctatcttaccagagtaaacgcggaagaaagtcaaacgtccgacataggggtcagttgcaatcttaaatgccaaagctgacgttttttcatcctcactaggtttacgatcttcctctgctcctgtgctcgggttagtacctacgatagcaggcgtatccaacggagaaggcaagaatgcacaaacatagtcaagcaatgtctgaactcccttattcttgaatgaagagccacagaacatcggaacgatatccatcttcaatgtacctgcacgcaaagcacgcaagatttcttcttcagtgattgtagaaggatcgtcaaagaatttctccattaaagcatcgtcaaactcagctactttttcgagcattttttctctccattcattagcttcatcaaccaagttcgccggaatttcttctacgctataatctgcacccattgtttcatcgtgccacaaaatagccttcattttgatcaaatcaacaacccccttgaaactctcttcagcaccaataggaattaccacagggcaagcatttgcacctaatacatccttcatttggcgaacgacttcgaaaaagtcagcaccagaacggtccattttattaacgtaaccgatacgaggaacattatatttatcagcctgacgccatacggtttctgactgaggttcaacaccacctaccgcacaataagctgcaacagctccatccaagacacgtaaagaacgttctacttcagcagtaaaatcaacgtgccccggagtatcaatcaagtttattttataagtatttcccgcatatttccaacgagtagtagtagcagcagatgtaatagtaataccacgttcctgctcctgctccatccagtccattgttgctgcaccatcatgcacctcaccaattttgtgagtcaagccagtgtagaacaaaatacgttctgaagtcgttgtcttaccggcatcgatgtgagccatgataccgatattgcgggtcaaatgcaaatcatgtttagccattttcgtcctttacttattaattattacttgattagaatctaaagtgagcgaatgcacggttagcttcagccatacggtgcatatcttctttacgcttgtaagcgccaccctgttcgttaaaagcgtcaataatctcagccgccagtttatctgccattgatttaccaccacgtttacgagcgaaaagaatcaaatttttcattgagattgactctttacgatcaggacgaatttcagtaggaacctggaaagtagcgccacctacacgacgagactttacttcaatctgaggagttacattatccaaagctttcttccaaatttccaaagatgatttttcttcattaggaagttttgttttcactgtttccagtgctgcatagaagatctcataagatgtattctttttcccatcatacatcaagtgatttacgaatttagaaaccttctgatcattaaatactggatccggaaggatcacacgtttttttggttttgcttttctcatttttttctcaaaataatgtttttgtttggggctgcactttttccgtttacttcaacgcttcctctgaaacatttactcaacctttatagcttattccaacaaaccaaaacttaaattaaatattctttgtttcaggaattcagttacggtttacttctttccttttccttttgcaggagctgcagcttgtcctgctttaggacgcttagcaccatatttagaacgtctttgtgtacgaccagctacgccagctgtatccaaagtaccacgaacgatgtgataacgtacacccggaaggtctttcacacgaccaccacgcaccaacacgattgagtgttcctgcaagttatgaccttctcccggaatataagagtttacttccttagagttagtcagacgcacacgagcaactttacgcattgctgaattcggctttttcggagtagtagtatacacacgaacacaaacgccacgtctttgaggacatgaatccagtgccggagatttactcttctcaaccaaaacctctcttccttttcttactaattgttgaatagtaggcattttgtttgatttttaattattatatattgtttattaatttgctatactaagtccaaaactatacattttgggctgcaaagttacgaataacattttaataaacaatactttctactaataaaaatagtctgtttctcaaaaaaagtttttgaaaaacagactactatgttatttttgctacaaaagcccttatgcctcccctttaaatccgcttataggaggaatgaatgtttttccatccggtccattatttcccccattcatttcttccggcattcgaataggtccaaaattacgttcgtattttgcaacattctcctgtaatgcatacatcaaacgttttgcatgttcaggggtcagtacaatacgtgactgcactccagctttgggcaatcccggcattacacgcacaaaatcaacaataaattccgaactggaatgggtgataatggcaagatttgcatacgttccttgagctacttcttctttcaactctatctgcaactgattattatttttttcgttttccatgattttatactttagcattaaaaaatattctgaatctcaatatccccaactcctattctttggttggagtacaaatatagacatttatttgtaataatacaacatacttattattctatataattttcctatagcatctactataataaacctaaagaggctgatttcttagacagaaatcagcctcttttacagtgtatatattaaaattactctacctcactataatcgagtacattcttacgattggcaagaatacggtcatattcttccttcgaaccaacaataatcttttcgaattcacgctgaccagtaccagcaggaatcaagtgaccacaaatcacattttccttcataccttccaatctatcaaccttaccattaatagcagcttcattcaaaactttcgttgtttcctggaatgatgcagcagacatgaaactcgaagttcccaaagcggcacgggtgataccttgcaaaatctgggtagatgtagcaggaatagcatcacgtacctcaacaggcttcaagtcacgacgtttcaacatactgttctcatcacgcaacttacgagcagtaacaatctgacccggctgcaaattctgagaatcaccagcgtcaacaactactttcttgccccaaatacgatcgttttcttccataaactcttgcttatccactacctgctgttccaagaagcgagtatcgcccggctcatcgatttctaccttacgcatcatttgacgaacaataatctcaaagtgtttgtcgttaatcttcacaccctgcaaacggtaaacgtcttgcacttcatttacgatgtattcctgtacagccgtgggacctttaatggccaaaatgtcagcaggagtaatcgcaccgtcagacagcggagttccggcacgaacgtagtcattctcctgaaccaatatttgtttagacagattcaccaaatactttttcacttcacctgtcttagatgtgacaataatttcacggttaccacgcttaatcttacccatagtaatttcaccgtctatttcagaaacgacagcaggattagatggattacgagcctcaaacagctctgtaacacgaggaagaccaccggtgatatcaccagccttgcctacagcacgaggaatcttcacaataatgtcaccagctttcactgcctgaccgttttcaaccacaacatgcccccccacgggtaagttataagtacggatcaaattaccatcctcggttacaatatgggcagaaggtacttttgtcttatccttagactcgataatgataatttcacgcagaccggtagcttcatcagactctaccttataagttacgttttcaaccacactctcgaattcaatcttaccagtagcctctgtgataataacagcgttgaacggatcccacttagcaatcagttttcctttctcaacaatatcaccgtccgcagcatataattttgaaccataaggcacgttatgagttgacaggataattcctgtattcacatcgataaagcggacttcagccaaacgaccgactaccactttcacagcctcacccatttcatcaaccgtatctaccgtacgtaattcttcgaattccaaacgtgcattattcttggcgacaatgcttgcattagcagccatattacctgcgataccaccggcgtggaatgtacgcaatgtcaactgtgtacccggctcaccaatagattgggcagcgattacaccgactgcttcacctttctgaaccatacgactggatgccaagttacgtccataacacttagcgcataccccttttttagattcacaagttaataccgaacggatttcaacgctttcaatcggagaatcctcgatttcctgcgcaatatcctctgtaatctcctctccaccggctacaatcagtttaccagtagtaggatggacgatatcatgtacagaaacacgtcctagaatacgttcgtacaaagtagcaataacttcatcgttattcttcaaggccgtacaaaccaaaccacgaagtgttccacagtcttcttcattgataatcacatcatgcgacacgtctaccagacggcgggtcaagtatcccgcatcagcagtcttcaacgcagtatccgccaaacctttacgagcaccgtgggtagaaataaaatactctaacacagacaaaccttctttaaagtttgaaagaatagggttttcaataatctgtgcgccttcagcaccggctttctgcggtttcgccatcaaaccacgcataccagacaactgacgaatctgctctttagaaccacgggctccggagtcaagcatcataaatactgaattgaagccttggtcatcattcttaatcgtcttgtaaagtatatcagacaggtcactgttcacgtgagtccatgtatcgataacctggttataacgttcattgtcagtaatgaaacccatgttatagttcatcataatctgttccacttcctcattaccacgttttaccagttcttctttttctttcgggataataatatcacccaagttaaatgacagaccacccttgaacgccatatagtaacctaagttcttaataccatccaagaattcacaagcacgtgcaacaccgacagctttgataacatcactaatgatatctcgcaaagactttttggaaataatggtattcaagtaccccacttccgccggaacgatttcatttacaatcacacgccctacggaggtttctttcatcatcacatctacgattttgccatctttgtccaagtccttcaccactacgttgacgatagcatgaatatccactttaccttcattataagcaatcaaagcctcttccggaccgtagaaagtcaagccttcacctttagccccttttctcaacttggtaatataatacaaaccaagtaccatatcctgtgcaggcacagtaataggagcaccattagcagggttcagaatgttatgagcctgaagcatcaacatctgtgcttccagaatcgcatcattactcaaaggcaagtgaaccgccatctggtcaccatcgaagtcggcattgaacgctgtacaagccaatgggtgcaactgaatagctttaccttcaatcatatgcggttggaaagcctgaatacccaaacggtgcagagtcggcgcacggttcagcaatacaggatgacctttcatgacatgttccaagatatcccagatcacaggctccttgcggtctacaatcttctttgcagattttacagtcttcacaataccacgttcaatcaacttacggatgataaacggcttgtaaagctctgcagccatcagtttaggaataccacattcacccatcttcaattcaggaccaacaacgattaccgaacgagcagagtagtcaacacgcttacccagcaagttctgacggaaacgtccttgcttacccttcaagctatcggacagtgatttcaatggacgattagcgtcagtcttcactgcacttgatttacgtgagttatcgaacaaggaatcgacagcctcctgcaacatacgtttttcgttacgcaaaatcacttcgggagccttgatttcaatcagtctcttcaaacggttgttacggataatcacacgacgatacaagtcattcaagtcagaggtagcaaaacggccaccatccaacggaaccaatggacgcagttcaggaggaataaccggcacaatacgtacaatcatccattcaggtttattacgtccgcgagatgcacggaacgattcaactacctgcagacgcttcaaagcctcattcttacgttgctgcgaagaatcattacttgctttatgacgtaattcataagataaagcatccaaatccaaagttgagagcagatcataaatagcttctgcccccatcttagcaataaacttattcggatctgtatcttccaaatattggttttctttaggaagtgtatccaagatatccaaatactcttcttcagaaagcaaatcatatttattaatgccatcttcagccttcacacccggctgaataaccacataacgttcataatatacaatagcgtctagtttctttgtaggcagccccaacaaataaccgatcttgttcggcaatgaacgaaaataccaaatatgcgctacaggcacaactaactgaatatgtcccatacgttcacgacggaccttcttttcagtcacttcaacgccacatcggtcacaaacaatacctttataacggatacgtttgtacttaccgcaatgacattcgtaatctttcaccggaccgaaaatacgctcgcagaacaaaccatcacgttccggtttgtaagtacggtagttgatcgtttcaggcttcaacacctcaccgctcgaattctcaaggatttcttcgggtgaagccaagccaattgagattttcgagaaattactctttatcttagtttcttttctaaaagccatacttccttatttataatgtaaagagttatatttttttattattcaaggttgatactcaagccaagacctctcagttcgtgtaacaatacattcagagattcggggatacccggagttggcataggttcacctttcacaatagcttcgtaagcctttgagcgtcctacaacgtcatcagacttaatggtcagaatttcctgtaagatatgtgctgcgccgaatgcttcaagcgcccaaacttccatttctccgaaacgctgaccaccgaactgtgccttaccaccaagcggctgctgagtaataagggagtacggaccgatagaacgggcatgcatcttatcttcaaccatgtgccctagtttcaacatataagttacacccactgttgcaggttggtcaaagcgttcacctgtaccaccatcacaaagataagtcttacaataacgaggcaatccagctttatctgtccattcatttaaatcatccatagaagcaccatcaaaaataggagtagcaaatttcacacccaactcttttccggcacgacctaatacggcttcgaaaatctgaccaatattcatacgagaaggcacacccaacggattcaatacgatatctactggagtaccatctgctaagaacggcatatcttcctgacgaaccacacgagaaacaatacccttgttaccgtgacgtcccgccatcttatcacctacaccaatcttacgcttcttggcaatataaaccttagccatctgaataatgcccgcaggaagttcatcaccgatagtgatagcaaacttcttacgctttaattcagcatccaattctttatatttcttcaaataattcatcaccaagtcgcgaatcatatcattcttatgagcatcagctgtccacttgctcaactggataatagtataatccaatgattccaaatcgcgtttggtgaacttcgcccccttggcaataacttccgttcccaaataatctttcactccttgggaaaccttaccattagtcaaaaccaatagtttctcaatcaaaatatctttcagttttgctgccttttcttcgaattcatcattcagtttaggcagaatagccttatcggcattcttctcacttctactcttgataacacgtgagaacaacttcttgtcaataacgacaccacgtaatgacggagaagctttcaatgaagcatccttcacatcacctgccttatcaccgaaaatagcacgaagcaatttttcttccggagaaggatctgattcacctttcggagtaatcttaccaatcaagatatcacccggttcgatacgtgcacctacacgtacaataccgttttcatccaaatctttggtagcttcttcactcacattaggaatatcagaagttaattcttccataccgcgtttcgtttcgcggacctccaaaatatattcatcaacgtgtacagaagtcagcaagtcctcacgtacaacgcgttcattcaatacaatagcatcctcgtaattataacctttccaaggcatataagccaccaacaggtttttacccaatgcaagctcaccaccctgagttgaatatccttcagtcaggatatcacccttcttcacacgttggcccttatcacaagtaggacgaaggtcaatagtcatgctttggttggttttacggaatttaggaattctatattctttcaaagcaggttcgaagcttacgaattcctcatcttcatttctatcgtacaggatacggatagtcgttgcatctacatattctacaacaccatcaccttctgcagcaatctgagtacgagagtcttcaaccaattgtttttcaatacctgtgcctacgataggagcttctgtacgcaacaaaggaactgcctggcgcatcatgttcgatcccatcaatgcacggttagcatcgtcatgttccaagaacggaatcaaagaagcagcaatagaagcgatctgctgtggagaaacatccattaactctacttggtcaggagtaacaaccggataatcagcatcacggcgggcttttactttctcacgaacaaatttaccttcatcatccaacggggcattaccctgagcgataatcttatcctcttcttcttcggctgtcagatattcaataccttcatcagatatatccaccttaccatcagctactttacgataaggagttgaaataaagccaagctcattaatcttagcatacacacacaaagaagaaatcaaaccgatattcggaccttcaggagtttcgatcggacataaacgaccatagtgagtatagtgtacgtcacgaacctcgaaaccggcacgctcacgtgacaaaccaccaggacctaacgctgacaaacgacgcttgtgagtgatttcagccaacggattagtctgatccatgaactgagacaaagcatttgtaccaaagaatgaattgataacagaagaaattgtctttgcattaatcaaatcaatcggtgtaaacacttcattgtcacgtacgttcatacgttcacgtatagtacgagacatacgtgccaaaccaatcgcaaactggttagacaactgctcgcctaccgtacgtacacggcggttgctcaagtggtcaatatcatcaacatccgctttagaattaatcaactcaatcagatacttgatgatttcaataatatcttgttttgtcaataccttcacatccatatccgtagtcagacccaactttttgttgattctatagcggcctacttcaccaaggtcatatcttttttcagagaagaacaggttgttgataacctcacgggcactggcatcatcagccgggtctgcattacgcaactggcggtagatataaagcacagcctctttttcagagttactcgggtctttctgaagagtattaaatataatagaatagtcggatgaattcgcctcttccttgtgaacaaggatattctgaacgcctgaatcaataatttcatcgatatgctcctcttcaattacagtttcacggtcgatgataacctcattacgttcaatagaaactacttcaccagtgtcttcatctacgaaatcttctgtccatgttttcaaaacacgagcagcgagttttcttcctacgactttcttcaaattagtcttgttaactttaacgtcttcagccaagttaaagatttcgaggatatctttatcattttcaaagcctacagctctcagcagagtagtaacaggcaatttctttttacggtcgatatacgcatacatcacattattgatatctgttgcgaattcgatccatgaacctttgaacgggataatacgggcagaatacaatttcgtaccgttagcatgtacgctctgaccaaagaatacccccggagaacgatgcaactgagaaacgactacacgttctgcaccattaattacaaaagttcctttcggagtcatatacggaataggacccagataaacatcctgaatgactgtgtcaaaatcttcatgatcaggatcagtacaatacagcttcaatttcgccttcaagggcacgctgtatgtgaggccacgctccagacactcgtctattgaatagtgaggcgggtcaatgtaatagtccaagaattcaaggacaaagttattacgagtgtcagcgatagggaagttttcagcaaataccttgtacagcccgtcattcttacgtttttcgggcggggtatccaactgtaaaaagtcttggaatgacttcaattgcacttccaagaaatccggatacttcatcggattcttaatggaagcaaaattaactctttgattttcagtatttgaagacatttgttaatattttgtagaacttaataataatatagacacaaaaaggttaagaatcctctaccagaggattcctaaccgtattacctgatactcaggttaatattatttaagctcaacttcagctccagcttcttccaaagttttcttcagtgattcagcttcgtctttagccaagccttcttttactgtgctaggagcaccgtctaccatgtctttagcttctttcaagccaagaccacatgcttctttaacggctttaacaacctgcaattttgcagcaccagcgctcttcaaaactacatcaaaagatgttttttcttcagcagcagctgcaccagcagcaggaccagcagcaacagctacagctgcagcagcaggttcaataccgtattcttctttaaggatagttgcaagttcattaacttcttttactgtcaagttaactaattgttctgcaaaagctttcaaatctgccatttttgtatgattttaattgtttgttactaattgattataaaattgattattcggcgcgttcgcccagagttttaagtactccatgaatggtgttaccacctgattgaagagctgaaataacattcttcgccggtgattgcaacaatgcaataatgtcagcgataacctcattcttactcttgatattgcagagagcatccagttgatctgcacctacatagaaaccttcttcagcataagctgccttcaatgcaggaatgtcctctttgtattctttcaacaactttgcaggagcgttagctacttcgctaaacattacagaagttgtacctttcaaagaattgaacaacggagagaaatcaacatcttccatgctcatcagagctttgtgaagcaaagaattcttcacaacaaccagcttaataccggctttgaaacattttcttctcagttcacttgtcttagctgcgtccatagcagttgtgtcaaccaagtaaaaatgtccgtattgcttaacggtttcagccaactgaccaataataacgcctttatcttcctttctcatgattcctccttattattagttttcttctacagttttgggatcaatcttgacacccttactcatagtacttgaaagataaatactcttaatataggtacccttagctgagcttggtttcaatttgatgatagtagcgataaattctttcgcattatcacgaatctgatctgcagtgaaagacaccttaccaattgaagtatgaacaataccgctcttatcaaccttaaagtcaatcttaccttgcttaacttccttaacagccttagctacatccatagttacagtaccactcttaggattcggcattaatccacgaggaccaagaacacgacctaaagcaccgatcttacccatgatagacggcattgtaatgattacatcaatatcagtccatccacctttgatcttttcaatatattcatcaagaccaacatagtcagcgccagcttcttttgcagcagcttcagcatcaggtgtacacagaaccaaaacacgtacttgcttacctgttccgtgaggcagcgaaactacaccacgaaccatctggttagctttacgagggtctacacctaaacgtacgtcaatatctaatgaagcatcaaatttagaaaaagtaatatctttaactaactgtgcagcttctttcagtgagtatgctttccctgcttcaattttttctgcagccaacttttgattttttgtcagtttacccattataattgaagtttattagttattacccgggaattccccttttacagcgatacccatacttctagctgtaccagctaccatagtcatagcagactcgatagtgaagcagttcaagtcaaccattttgtcctgagcaatcgtacgaacttgttcccatgtaatttcggcaactttcttacgattaggctcagcagaaccactcttaatcttagccaattcaagcaattgaatagctacgggaggagtcttgataacaaaatcaaaagacttatctgcgtagtaggtaatgattacaggtaaaattttacctgctttgtcctgggttctggcattgaattgcttgcaaaattccatgatattaatacccttagaacccaaagcaggtccaacgggaggtgatggatttgcagcgcctcctttaatctgtaatttgattagtccagcaacttctttagccattttgtttctaatttttatatattaattatagcgaaagtccaatgcacgtaacagaatgcattattctttctcgacatccataaagccaagttccagcggagttttacgtccgaagatcttaaccataaccttcaacttccgtttttcggtgttcacttcttcaatgagaccactgaagccactgaacggtccaacggtaactttcactgtttcgcctacggtataaggtacattaagttcctcaccactttcctgaagttcatccaccgtaccaagtatacgattcacttccgattgtctcaaaggaaccggattttcggaacctcccaagaagccgattacattcggagtgtttctcaaatgatgagcaacttcaccgaccaaagcggcctcgactaaaacgtatccgggaagataacttctttctttcacaattttcttaccattgcgaacctgatacactttctcggtaggaatcaacacctgagacacatactcgctaaggtcactgttcttaatgtcagcatcaagatattctttaaccttgctttcttttccactaacagcacgtaatacgtaccactttttttcaatctcagacattttattcaattaattagtgcggatagataatatcctccattacaaactggaagactgaatccataagaaaaacgactaacgcaatgagtagggaagcatataaaacaaccactgcgctactagaaagttctttacgagtcggccatgatactttatggactaattcgtcgtaagattctttacaataatttgctactttctgaaacatattctttcaagtttagcacgggaggagaggttcgaactcccgacacccggttttggagaccggtgctctaccaactgagctactcccgtaaaaatcagttcccgaagccttacgaccgagaactgatcatatatatttatccaagtgttagtcaagaagttctgttatctgtccagcacctacagtacgtccaccttcgcggatagcgaaacgcaaacctacattcaatgcaaccgggtaaatcaactcaactgtaatagttacgttatcaccaggcattaccatttcagttccttccggcaaagtgatttcacctgtacagtccattgtacgcaagtagaactgaggacggtatttattgtggaacggagtatgacggccaccttcttctttcttcaagatataaacctcagctttaaacttagagtgagccttaacctgacccggcttacacaaaatcataccgcgtttgatttcgtttttgtcgataccacgcaacaacaaaccaacattatcaccagcttcaccttgatccaacaatttacggaacatttcaacaccagtaacaacagatttcttatcttcacccaaaccaaggatttcaacttcgtcacctacatggataacaccagcttcgatacgacctgtagcaacagtaccacgaccagtaatagagaacacgtcttcaacaggcatcaagaaaggtttatcaatatcacgcggaggcaatggaatccacgtatcaactgcatccatcaattccattactttctcttcccattgaggaacaccattcaaagcacctaatgcagaaccgcgaatgataggagtattatcgccatcgaaatcatagaatgaaagcaattcacgcatttccatctccaccaattccaacatttcctcgtcatcaaccatatcacacttattcaagaaaacgaccaaacgaggtacatttacctgacgagccaacagaatatgctcacgagtttgaggcatcggaccatcagttgcagcacaaacaataattgcaccatccatctgagcagcacccgtaaccatgtttttcacatagtcggcgtgacccggacagtcaacgtgagcatagtgacgatttgcagtttgatattctacgtgagaagtattgatagtaatacctctttctttttcttcaggagcgttgtcgatagaatcgaaagaacgcaattctgaaagaccttttttagccaacacagtagtgatagcagcagtcaaagtggttttaccgtggtcaacgtgaccgatagtaccaatgttaacgtgcggtttcgaacgttcaaatttctctttagccatagctttacttgttatttatttgattaataatcagcaattacgttattaaagagctgttaacgagacttgaactcgtgacctcttccttaccaaggaagtgctctaccactgagctataacagcaaaaaaagagcggaagacggggctcaaacccgcgaccctcagcttggaaggctaatgctctatcaactgagctacttccgcaaagaccaaagacctttcaagtctcaaaaagtgtgggcaaagatggattcgaaccaccgaagtcgaaagacagcagatttacagtctgccccatttggccactctggtatttgcccaacttatttttcaaagaacaactagcttctcagcaccttttcttgagcctcttgtcggattcgaaccaacgaccccgagattacaaatcacgtgctctggccaactgagctaaagaggcttgtcatacctaacttcacaaccattccaccttggatggttaagcggctgcaaagttagatatttattttaaatctcaaaaactttcagcgattttttttatttaccgcgcagtttttctttatattttgtcaattgcttggaaagcgcatctacgcacacatcaaccgactcttcaaatgtatcactcaccttttctgcaaaaaattctccattaggcaccaacactttcatactagcctccttattcattgcagtttcaggctttacaacttttaatgacacctccactttatttatatcgtcacaatacttttctaacttagcagtcttcttctggataaaatcctgaagtctttctgttgcatcgaaatgaatagcttgaattctaacttccataaatacctcctttttttacgctcttggatgagcttgttcataaacttttttaagttcctcaaaagtcgtatgcgtatagatttccgttgtagtcagactactatgacccagtaattcttttaccgcgcccaactctgcctcattattcaacatagcagttgcaaaagtatgcctcaacacatgcggacttctttttttcagcgataccacttttgaaaggttccgtttcactaaaagatatacctttccaggatacatccgttttccgttctttaaaacaaagaacgccccagcctttccaggtaacacttcattccttatcttcaaataaacaaacatcgcccttcgcagttcttcaccgaaaggaatcaaccgctgtttatttctcttccctgtcacttttatcagagatgcagagaaatcgacatccacgtcattcagccctattaactcggaaagccgcatgcctgtagcataaaacatttccaataccattctatcccgacaacctgtaaaatcctccttaaaaggaacatcatccaaaagtcggtccatttcacgttctttcagaaatacaggaagaggcttcttgtttttcggaccaatgattttcaacatcggatcctcccctatcacacctttctttagaaggaaacgataaaacgatcggagtgaactcaatttccgatttacagaagcagatgtatatccgtcctctatcaggttcatcacccaaccacgaaccaaatcagcatctaccgttgtaaaatcgacattctcatcttttcccctgatgtattcttcaaacttgatcagatctattccataactaactattgttttctcagaatagtttctttcaaaccgaagataatccaaaaaagagtctgtcatcataagaaacgtcgcttatcaattcagcaacgaatatatgaaaaagaattcaattattcaaagaatgtgcgagtttttaattattcttctacttgctgaagtttctgaacatagatagcacgttctcttttcagcctgttcaatacagacggcttgtcaaactgctgtctagctcttagttcttttacaacacctgttttctcaaattttcttttgaacttcttcagcgctttttcaatgttttcgccttcttttactggtactacaatcattgtttttaattattaaatatgttgttattaatattttcagatagtcaaattgcggcgcaaaattacacatactttctttatttacaaaactttccgcaattatttatttaaaataatctagaaatcgtatctttgctttccagtacaaaccattataaacctattaaaatgaaatcggaaattataaatagaatagttagtctgcgcaatttcatgcgtaaacacaagctttcagcctttattatccccagtacggacccccactcgggagagtatatccccaaacattgggaagcacgtaaatggatatcaggtttcacaggttcggcaggtacagttgtcgtaacgctggataaagccggactttggacagattcacgctattttcttcaagcgaccgcacaattggaaaacacaggcattactttattcaaagaacgattaccggaaactccttccattgtagagtggttgggctgtgtattgaattcagaagataatgtgggtatagacggttgggttaacagctatcaagaaacaagcaacttacagaaagaattagaaaaaaaccagatacacttaacccttactcccgatccattcaatgaattatggacagaccggcctgcattgcccgacaacaaagtttttatacatgaattgaaatatgccggtctcagttgcaaggataaaatcactcaaatacaagaagccacccgtcgtaacagttgcacaggcattctaatttctgcactggatgaagtggcatggactctaaacttgcggggaagtgacgtacactgcaatccggtttttgtgagttaccttctcatcacggaatatagttccaccttatatataatagagaataaactgtcagatgaagtaaaagactatctagcagaaaacggagttacagtgaaaccttattcaacaattgaaaaagatttaaaagattttaccggcaaactcctgttgtcagctagtatcaatgcagccattcatgcagcagcctgcacccattctttaatagaaatagctccttcacctgtactttttttaaaagcggtaaagaatgagacggaaatagaaggcttccatcgcgctatgaaacgcgacggaatagccatggttaaatttctccgctggctgaaaacagctgtttctactggaaatgaaaccgaaataagtatagataagaaattatacgaattccgtgccggacaagactacttcaatggtatcagttttgacaccattgccggatataaagctcatggcgctattgttcactatgaagcaagccccgaaaccgatatccccttaaaacctgaaggtatgctgctgctggacagtggagcacaatatttggacggaacaactgatattacccgtaccatcgttttaggagcgctcacgaaagaagaaaaaacggattacacattagtcttaaaaggatttatccaactctcaatggctcaatttccacatggaacttgcggaacacaactagatgcgctggcccgcctccctatgtggaaagccggaatcaactacctgcatggaacaggccacggtgtaggttgtttcctgaatgtacacgaaggtcctcaccaattccgcatgaaccacatgccagccttacttgttccaggcatgacagtaaccaacgagcccggtatatataaagccggccgtcatggagtacgtacggaaaataccatgttaattgttccgtcacaagagacagaattcggtacttactataaattcgaaccacttaccctctgccctattgacaaagaagccatcctaacagatatgctgagcgatgaagaaataacatggttcaaccaatatcatgaaaaagtttacaattgtttgagcccggaattgaacaacgaggaacgcgagtggttaaaagaagtaacatctcctttaaaacggtagaaattaattatggcacttataaaatcagtaagaggattcactccaaaaatcggcgaaaactgttatttagccgataatgccactattattggtgatgttgtaatcggaaaagattgcagcatttggtttaacgccgtattacgcggcgatgttaatgctatccgcataggcaaccgcgtaaatatccaggatggcagtgtagtacacacactatatcaaaaatcagttgtagaaatcgggaatgatgtttctgtaggacataatgtaaccatacatggcgcgactataaaagacggcgctctgattggaatgggctctaccgtactagaccacgctgtcgtaggtgaaggagctattgtagctgcgggagcactagtactcagtaacaccgtcatcgaacctggaagcctatgggcaggagttccagccaaattcgtcaaaaaaattcccgaggcacagagcaaagagctcaatcagaaaattgccaatggatatttaatgtatgcttcctggtttaaggaggaagaaaaataattctacatataaagaaaagttagtattcatttaaaatgattgattatgaaaaaaattattattgcagcatgcatgacgcttttaagttttagttctgtttttgcacaaaaaggaaagcaagctattggtggtaatctaagttatggaactgaaatagagagtattggtcttggtctgaaatatcaatataatattactgatcaaatcagaatcgagccatctatgaattacttttttaaaaatgacggacttagcatgtttgacatcaatgcaaatatccactacctttttcccatagcaagcaatgtaagtttatatccattagcaggatttacatacactaactggcatttggatttaggaaaagtaggcgattacgatgtcagtggaagtgatggaaaattcggagttaatttaggggcaggcatggagtttaccttagataaaagctggagtctaaacctcgacattaaataccaattaattagcgatttagatcaagcagtattcaatcttggcgtagcctataatttctaattaataaccagagaaggataaaagtgcttttaaatgcacctttatccttcttcaccttacaaagaacaaacctgctctacctatttttacactaacttacaaatatggcacactatgaataaaatacgactactcacaaaagatgagctcccaaaagctatcgaactatcctggcaagttttcaccattaccagcaaagaagatttcaacgatgagggattagaatttttcaaaagctttatttataacgaaaaatatatagacgaaatcacattttacggtagttttaacaataaagtcctaacaggcattttaggtataaaaaataatggtaaacatatctccttattttttatcaagcctgaatatcacaggcaaggattagggaaaacccttttccactacgtcttcgcccttcatccttccattgaaaccacggttaattcttctacttacgccattcctttctaccagagtctgggatttgctgtcgtaggagaaaaacaaaattaccacggactctgcagcacccccatgagacgctatcatgctgtatttgtacaaaagcaaaagtacacactacgtacctggcaaacagaagacgctcattcattagttcaagaactgaataacaaaaagatttgggacaattgccgcaatgtattcccccacccttacaggctggaacatgcagaaacctttattgacctcatcaagaaaaaagaaggtattcatgatttttgtattgaagtcaatggaaaagccgtaggtaatatcggatttatacccggcacagatgtggaatgcttcaatgccgaagtagggtatgttatcggagaaaaatattggaaccaaggtattgtaaccgacgcattacaagaagccatctaccattacttcacttatacgaatacaatacgtatattcgcacttgtctttgagcacaactttccttccatgcgagtattagaaaagaccggcttcaacaaagtcgggataatgacaaaatccattttcaagaatggtcatttcaccaatgcccatcttttcgagttgcttaaaaacacttaatgttcaaaaaatgccaaaagaacttacaatgaatgttatattacacatattcatcctttgtccgaaagacataaccccactcctttcacagtctttatctgtatccgttcatcatcagcaaacagttttctaagtcgagtaacaaaaacatcgagactacgtgatgcaaaaaaatcatcctccgtatcccatagtcttgaaagaataacatcccgtcttactagttcatttttctttttacaaagcatctgaagcagtttcgcttcgcgttccgtcattgtcttttgtacacacgacgaacactttaatactgcatgaacagcatcaaatgtataattttcaccaatctgataaacctcactttcattagcagctcccattccctgcttcattttcaacaaggcaccaatatgcgcatccagttcttccgccaaaaaaggtttcttaatataattattcactcccagttcataacctttcaccacatctttaggcgaaactctacccgaggtaaaaacaatgggaataaatccatccgtttcccggatacgacgtaccatttcataaccatccataacaggcatctcaatgtctgaaataatgatatcgggatgttgctccttccatatcctcagcccttcctcgccattggaagcagtcatcacctcgtatccacctatcatatcctccaatccaccacggataatgtaacaaagattagtatcatcttctaccaacaacagttttatcatatcatcttccttctttaaaaaacatttataccctctcctcactcggcaaaaaaagaagaaattcactatactccccttcaatgctttccacacacacttttccaccatgcgcctcagccacgcggaaaacataattcaaacccagtccgaaacctgacgcaccacctttacggctgcggtcggcagccgaagcacgttcgtatttctcgaagatacggctctgatccttcaacggaatacccatgccgttatctcttacctttatcaaataaaagttatggtcctggcgcaaggatgaaatctgtatttccacctcttcacctgaatattttatagaattgtctaccaaattaccaatagcttctttcaagaattcttcatcagcatatacccattctgattccaaacgaagagagaaatgtacaggtttatctgccttagcagtatatttctcaatgaggtcctctaacatcggacggagttgtacctcctctttccaaagcctcaattgagcattttccaattttgacagcgtcagcaccttgttggtcagtgacaataaatgttcactctcgtcctccaatatctgaaaatgcttctcacgtttatccggataaatatccaactttcctgatttcaacattcgggtccccatcaagatacaggcaagaggagtcttcatctcatgaatcatggcgtatgagaaatcctcacgcattctagctattttattctgatgggcaataatacgaatctgataaacaagacaatagacaatcattgccatcatcaagacagtagcaatgagaagcaaggtcatctgttggaaaataatccaataaggattaacaataaaagcctgaagattctccgtgcgtttataattgataggttgtaatccggttttcaacaaaccataatcccccacctgtatggaacgggagcttctaagaatattccccagcgaatctgtcacacaggttattacctctgcatccaatccttcggcagcaagacctgtccgataaatagaatctaaacttgacaaagaaacagacaatttataatccctcttgacaatctcttgcatggaaacctgcatattggacatcaaccattggttcacattttcatcaaccctgtcatccttaaaaagatcataatcttcatccaagcttattctaaccataatggaagtatctctgtccttatacttcttttgcaaagaatcttgatatacttccatgcgataaaacacctcacgcatcgttgcatctctaaatacttcattgcttctgaactgtatactttccttagttagcttataagtatttacaagccaaacgtactgcaaactgatgattgccaacagtccaatacaagccacccaacgaatatgtttgattgtcatacacttatatcctatccatactttgttaacgtaatgttaacctgctattaaccaggtaaggaaaaaagtctccctacttttgtttcgtcaaagttaaagaaaatattaaaaacaaatagatatgaaaaagcaaaattttatcatcacatcgctatttttattttggattataggaacaaccgctgcacaaaccattaccggaaaggttataaacatccatgcacaagccattgacggtgcaaccgtcatcctacaaatcattgattctactttcgtggacgccgtaatcacagataccaccggttgctttaggttcaaccggcaaccagcatcttatcggctgattttccaacacatcatgtacgaaaccctcttattgacaactacaggagaagacacaggcacgattaccctgaaaagtaaagattatgccctggacgaagttatcgtcaaaggggaacgccctcttgtaaaagtggaagaaggaaaattatcgtacgatctgtcacaactcaccacacatagaatcgtgaacaatgcttatgaaatccttcagcaattacccggtgtacaagaaataaatggcaacctttcattggcaggcgcacacaatctgagcattattctaaacggaagacccacaacaatgagtcacgaacagttagccattttattaaaaaacactccggcttcacgtgtagaaaaggtagaagttatgtatagcacaccgccgcaatatcatataagaggtgctgccatcaacttacttttgaaagtttatcgtccggaagaaagcgggttgcaaggagaagttaatgccggatatctatacaattacagaaatggcacacaaggaggaatcagcctactttacaccactcctaaatggaatatagacttgctatataatacccattatgaacaaaacagacaaactacagatacgtactcacaccacaccttaaaaaataatgtatatgatatctgtcaacacaataacattgacagaaaaggaataacacattatgtacggacaggcgctgaatataaattcaatggtagtgctcatatcaatttggcctataccggtatcttcaaccctaacaacgataatcattcgtattccgacgggaacatcacaaccgcagacaatcggacaaaaaaggaggctcaaatgcacaatctcgctttagattatctctctggcttcggtatgaaagctggaataaattatacctcctaccattccgaaagtcatcagcaattcaccaacaaagacaacaaaaaacaaacaagcgaatttcatacgactagcggacaaataatagaccgctggaaaatatacgtagaccagtcacacacactaccacgagagtggaccttgaattatggcacctctttgacttatgccagtgaccataatactcagttctatcatacccaaaacggaacagatatgagcgaacttaacacagacaatcgttataacgaatatacatatgacttctatgtcggattcagcaaaaatatgggagaacgtttgtctttcagcgcatccataaccggagaatactacaaaacggcccgttatcatgcatgggcggcttatcctacagccgaattaacatacgtaatgaccccagcgcatattttacaacttgcattcacttcagataaaacctatcccagctactgggatctgagcgaaagtaccggctatataagtggttatgaagaagtacaaggcaatccaatgttaaagccatccaccgactattccgtaaatctgaattatattttaaagaacaagtatatcttcagcctagcttatgactatgagcccgatttatttcagcaactggcttatcagagtacggaacgcctgacattgatttacaagaccctgaactgggattatcagcaaagtttttcagccactgccatcattcccttcaaaataggccattggctggacagccgtgccacactacaagcagaatacaggcaggcgaaatgtgataaattcttcgacctttctttcaaccacagcaaatggattggattgggaatgttacagaataacctaacgctgtctacccaaccggacatacgcatggaactgaccggactttatttaagcccatccattcagggaaattatgatttaagcaatgtatgggccatccatgccgggttgcgatggaattttgccaaccaaaaggcgagtcttcaactgaaagccactgatctgttcaattcaatgcaaggagatatagatgtaacactgcgcaataaagggcagtatatggacatgcacatcaacagttattcacgcaacgtaactttatcctttacttacaagttcggaggctataaagaaaaacagcataaaccaatagacacttcccgattcaaataaagcatcatcaatagtatcatgacacagtaataaggggcagattcgtacatccgcccctcattcgattatttcataacagaaagtatcttactatattcagactgattattcaatatctcaatagcttttttcagatcaggatcatctttcaagcgttgcagtatcgcgccacgttggaaatagtaacgtttcaaaatctcctgagcaatagcatcttttatctctttcgagaacctgtccaactcatgatccaaattatgcgtcaatttcgtttccaaagcggcaaactcttcttttgccccatccatatatccttcaaactctgctatttctttcaagttcttcagcatcttctcactttgccgatcataagtaaacttacgcttatgtaacatcttcttaaaatcaacatagtcagcatctgttattgtaaagtctttcacttcccctacctgagaatgcttgatacaatattgggtagcataatcaaaaatcatatcatcattaagcagataaaacataatgtttgggaaattttcaactttcacctccacatccggacgaataccgccaccatcacgcacttcacgtccggctgctgtatggaatacattggtcaggctgtccggagtacgggccacagacccgtcagcattacgtttagcataatcaatagcttgaatgcatcgtccgctgggaatataatattttgcagtagttactttcatgctactgttataaggcaattcacgaggaacctgtaccaaccctttaccatacgtacggcttcctaccacaatagcccgatcaaggtcctgcaaggaacctgaaacaatctcggatgccgaagctgtagaaccgtccactagcacagccagcggaatctctgtatctaccggttcattcattgttttataagtggtaccagcttgtttaatcttaccttttgttaccacaatctctttccctttcggcacaaagaaattcactacattcactgcttcccccaacaaaccgccaccattgccacgcaaatcgagaacaatagatttagcaccttgctgtttcaattctatcaatgccttctttatatcttttgaacagttctctatagcaaaagtactgataacgatatatcccacattattgcctacgattccataataaggtacagggttcgtacggatggtagaacgggttattttaaattccattggcacataagtactatcagaagtaggtctctcaactttcaacacacaagttgttcccggctcaccacgcaaattatcactgacatacgaggtcagatcattgggaattctgtctccctgggccatatcttttccattgatctccatgatgatatcaccggctttcagtcctatttcggcagcagggcttccttcggaaggttcaataatagccacacgctttcggggagtataataacgtattaccgatccgataccgccaaactttccgctagtcatttcctttagtgtattatcttcttcaggatagtactccgtgtaagggtcggtctgcgccaacatagcatcaataccatattttatcactttctcaggatcaatagtatcaacataaaacatatccaattccttgaatatcgcattgaagatatccaagttttttgctatctggaaattacggtcatcacctttattaaaactaaacaaagcgctacctgtcaggcccacgcaaatcattaacaatattttcttactattccacttcatcactttatgtatttgtgaaccgcaaattaatacattattctattcaagcctgtagaagggcctctatatttaactttatttcgtcccattttttctttgataaggttgtacccaccacttgtatcacattggatgctaaaatagaacctataatggaacacttctccaaagaataaccacaagtcagtccatacagaaaacctgctgcataataatctcccgcgccagtggtatccacgactttttttaccggaggtacctctagtttgatgcattccgtacctttctttatacatgaaccttgggcacctagttttactattacaacactgcatttagaagcaatttcattgatagccccccatgcatccttgcctgtataagcctttgcctcttcctcattagcaaaaacaatatccacgtatttagttatcaaaatatcgaagaattccaaatctccttccacaatattataactggccatatccaagcagatttgcaatccagcctcttttcctaattgcatagcacgaagaatcaattcatgatcctgtaccaagtatccttctatatatagatatgcataccccttaaacatatccaacgtcagattttcggctttcatagtggcagcagctcccaaataagtgccaaaagtacgttctccatccggtgaaatgaaagtagaagccactcctgtaggtaaatcaccggcaagtaatttcatgtcaattccctgcttcaaaccattttttttaaaatattgcccaaaatcatcgtttcctatctttccgataaatcccggatgtgcccctagattagctaatgccaagactgtatttcccacacttccccctgtagctttatgcgttttcatatcagagaatttaccactgattttcagaaatttatcttcatttataagttgcatacttcctttgggcaaactcatctcatctagtagcgaatcatcttgcaaagtaacaagaacgtcaaccaatgcattgcccattccaattattttatccatttatctaaaatttttctgcaaagatattgcatatttcggaaaaacctattatctttgcaccgcatttgagagaaaaaccttcttcgttagctcagtcggttagagcatctgactgttaatcagagggtccttggttcaagtccaagacgaagagcacaaaggttcgcagatagcgagccttttttattactatatataataaaagccttcatcacattcttttgtaattccattgtaatctccacccgccattttacttatattaccctcaaaaacaagatttccattcaaatgttttggaactatcttactattatttacatttgttgggaaacaagtactgatatgaaaacgcacatcatagcactttttctacttataggaggagcattgaatttatttggagaaaacttacataactttttcaaccgatataatttcagctttattacagaagatactgggttaccccataactttatcaatgatatttacaaagacactcaaggatatatctgggtagctactaataatggaataggacggtataacggctatcaatttattcattataattcccagtcccactccattcgcttgaaaaacgactacgtgcataaagtctgtgaggataagtttcaacgactctggatagggtcggaagaaggaatagacctcattgacttgaaacattatacacagatagacacggacaaagaactgcctgccgaattgaaatttctagcaagtaactacattgcatccatctatcgagacaagcagaataatttgtggatatcgacagacaagaatctatggtatctggaactaggcgtagacgggcaaataaaagattactataaactgaaaaaagatacagaatcccccatccacgctgttattgacctgcaagaatacatctgtgcaggcatagataatcatgtatgccgtattgaaaaagggagcaaccacttactgaaaaccagcatggtatcggagctgctgaaacccttttcagaagactggagaattctctgcatggaaactgacggggaattgttatggataggaaccaatcgcggactcttcaagtataaccatacccagcagagtttgaaccggtaccgttactccaatcatcgccccggaatgctaagtcaagcctatataaccggagttaaactgactagcaaaggagatgtcatcgtttccactctgaacggactcaatgtatacaatcgggataccgatacttttacttatatccgccaaaacaatgaaatgcctgacaagtcgttgaactgtaatttcatcaactgcctgctgaccgacaatgagaatatctgggtagggactgagataggaggaatcaatttattgactcccaattgtctgcaaacgtatgtgtggcaatacaactatctgcgagaaacctctctttcccccaatccggtcaatgccatcagcgaagacaaagacggaaatctatgggtaggaacagtagagggaggactcaacaaaaagagcaaaggcagcgatgagttcatccattatacttttgaccagaataatcccacttccattagtaacaactccatccgtggcattctcattgattccgaaaatcatttatgggcatatacttggggggtcggaatcaatgaactaaatctaaatataccccataaccaaactttccaacgccatatccgggaagactccataggattggagggagattttctaagcagcgcctgtgaagacaccatgaacaatggtttatggtttggtactaccagagggcttcatttctaccataaaaagaccaagcgtttcacccgggtcttgtttgaccgttccgacaatgaattcgatgcggtagggtccatcattatcgaccgcaagaaacgtctttggatgggaacatctgaaggagttttcattatggatttatactcgttctccatttcctccacacaattcagctatacctatttaaaacataaactgacggaacccacttcattgcaattagaaaaaataaactgtatcatagaagatcataatggtaccatctggctgggagcaaatgggaacggactatatcaactaacggaagaaaatggaacacagttcacatttcataactacacccgcaaggatgggttacccaataataccattataggtattgtggaagataaaacgggacatctgtggatgtccaccaaccacggcatcgcccaactggatacacaaaccatgactttcaccaattatacaaaagaagacggactgcccaataatcagttttattggaacgcatcttattattctccccaaaataatctgttatatttcggtactataaacggattagtcgctttcacccccgatatagccaagataaaaaagcaggatgccaaagtcaaactgacctcaatcagtgtcgccggtaccatggtctatcctccagcagacggaaaaactccctgcgcggtaacaaatttacataccatccgtctgcacgaaaaagatcatggtttttccatcgagttttccaccttaaactatggaaactgtaaccgagtgaaatatgcctaccgcttgaaaaattatgagaatgaatggacagaaacccttcctggcgaacatactgctagatacaatttcattccctccggaaaatatgtgttccaagtccgtgccacagacgagaaaggacattggtctgataaaataacggaagtcaaagtaaccatcactccttatttctataaatcctggtggttctatttattgcttgccattctgatcaccgtaggcagctattatttttatcaatggaaaataagtctgtaccgtcaacagaaaaaacaactggaaaaagaagtagcccaacgcacccatgagctagagttacaaaataaacaactagaaataatggcacgacacgtcgaggaggtaacggaagaaaaaattgctttcttcaccaatatcactcatgaattccggacaccagtcactttaatcaacggtcccatccaacgcgcccttgacgaaagccatgagccggaagtaaagaaacagctacaaatagctgaacggaattccaattatctgctatcactagtcaatgaattaatggacttcagaaagttagatgcagacaaagttgtattaaataagacaaacgaaaactttatccgccttatacaaaatatattaatgcctttcgaagtatttgcccatgaacggaacataaacatcatcacctacttccggctctgtaccccgttttggatatttgatgttgaatatatgcgcaaagccattattaatctgatatccaatgctgttaaattcactcccgattatggaaaaataagtttgtatgtggcttcccttaccgacaaagacaaccatacctggctgttcatagatataaaagatacaggtaatggtatcgtacccgaagatatagaacgtattttcgaacgcttctaccaatccaaaaagagcatcaaatatcccgtttatggacaaagcagcacaggaatcggactattcttatgtaagaaaatcatttctctacacggaggcaacatctatgcaggaaacaatcccaagcaaggagctttcttcagaatactattacctttggaaaaaggtatcccccaagccgaatcagaaaaagaaaaatatgagcagaatgaacacccactttccattcctgccaatggaaacgagaaaaaggaaaccatcctcattgttgaagataatgcagatatgcgtacttatatttgttccattctcaaaaacaattatcaattaaaagaagcacagaacggtgcagaagctctttacttgattcaaagagaaacgattgatttgattgtcagcgacctgatgatgcccgtcatggacgggaatgaattatcccgccaggtaaaagctaatctggctacttcccacatcccctttctcatgctcactgccctccggtccgaagcccaagaaagaatcagctacgaaataggagtagatgaatatctgtgcaaaccatttgatgaggttattctaaaattacgtatccgaaatatacttgccttacgccagaaatacaaatccatgttctccactagtatgaattgtgaaacattgaatataaacgctagttccaaagacaacacatttatgacatcggcaatcaatttaatgaaagaacattatgccgactcggattataacttagagcgctttatccgcgatatgggatacagcaaaacattagtcaatcagaaattacaatccttaacagggcaatccattggccaatttatgagaaactaccgattaaatgtggcaaaagagactttaaccaaagtcgaatgcaacatttctattgcagaaatcgcatatgctgtaggttttaacgaccccaaatatttcacaaaatgcttcaaagagctgtttggagtacttccaagcgaatattttggaagaaaatagttcactttactattttactccatttgtgcaccatattctcctatagaaagctttgtttcccttacatttgtaaaaaacagaaatgcaaatgtatatgaaaaacatattcttattattgagctggctgatactactcccctccggtatactggcaaaccctatcaagggaatgctggaaaggatagacaagggagcatcgaacaagttcgtagtcgaactacacaaaagctctaacgactttttcgagttagaccggaaaggcgacaaggtagtgatacgaggtaacacctatattaatatagcaaccggcatcaactggtacttaaagtatcatgccggaatccatctgtcatggaacggtatgcatgcctcactacccgatgttcttcctcccgtcctccgtaaggaacgccacgaaacaaacctagccctgcgttatgacttcaattactgcacctactcttactccatggcattctgggactggaaacgttgggaaaaggaactggactggatggcactacacggaatcaacctgccgctcgctgccgtaggacatgaatgtgtatggcgtaacctattactccggttggggttttccaaacagcaaatcaataattttattgccggtccggcattccttgcctggtgggaaatgaacaatctggaaggatggggaggccctaatcccgacagttggtatgaacaacaagaagccttgcaaaaaaagatattgcaacgaatgaaagaatggggaatgcaccccgtactgcccggttattcaggtatgatcccctccaagctggatttgggaaagcgtattgatagtggaaaagaaaagaaaacagcaagcgacacttcctcggaatccgcccaaagcaccctcaacaaatggaacggattcgaccgaccgggaatcttactgcccgacgatcccaagtttacccagattgccaaccttttttacgaagagaccgaaaagctgtatggaacaagtgactactactccatcgatccttttcatgaagccaaaagcttgcctgccggactagacttcggcaaagccggcagggctattatggatgcaatgaagaaggctaaccccaaagctgtgtgggtggtacaaggatggacagaaaacccacgtccggaaatgatgaaagcgctgaatcccggcgatctgcttatccttgatttatttagcgaatgtcgtcccatgtggggcattccctctatatggaaacgagacaaaggatacgaagaacacaactggttgttctgcctgttggagaatttcggggggaacgtgggcttgcatggaaggatggaccagcttcttcacaatttctacctgaccaagaacaatccactggccgctcagctaaaaggcatcggtctgacgatggaaggcattgaaaataatcccgttatgttcgaactgatgtgcgaacttccttggcgtgcagaaaagtttaccaaagaagaatggatcaaacaatacatccgcgcacgctatggcacagacgatgaatctatccggcaagcttggcagatcctggcaaacggtatctataactgtccggcaggcaacaaccaacaaggtcctcacgaaagtatcttttgtgggcgtccatcgctgaataatttccaagcatccagctggagcaaaatgtgcaactattacgatcccactaccacaacagaagccgcacggttgatggtgagcgtggcagacaaatatcgcggtaataacaactttgaatatgacctggtggacatcacccgacaagccattgccgaccgtgcccgaatagtgtacaattacgctgttgccgactttaaaagcttcgacaaaaaaaattatgccacacacacccgacagttcctggaactgttaatgatgcaagacaagctgctgggcacacgcaaggaattcaaagtcggaaactggattcaacaagcgcgcaatctgggaatcacatctgaagagaaagacctctacgaatggaacgcccgcgtacaaatcaccacatggggaaaccgctactgcgccgacatcggcaaattacgagattatgcccataaggagtggaacgggctgctgcgcgacttttattacaaacgttgggaaaaatactggcaagtactgcaagaccaactggatggcaaacttcctgtactgccagtaggtaattcatcaacccccactgccgataatccagccatgaccatagattggtatgccctggaagaaccatggacactggcaaagaacatctatgcggcatctgccgaaggtgattgtatagaagtagcgaaagaggctataacattgataaacaattgatagtaagatgaaaaaggaagagctcaatacagaaaccgcacagcaggcaccgcccattaaaaagaggcttttgtcactcgatgcactcaggggcatcactgtagcagggatgattctggtcaacaatgcaggaggcaaagtgtcgtatgcacctttgcaacattctgcatggaacggactgacactttgtgacttggtttttcctttctttctgttcatcatgggtatttcaacatatatttcattaaacaaattcaatttcaacgtttccctacaagtggtaaccaagatattgaaacgcacatttcttattctatgcatcggatgggcaatcggttggtttgaccatgtatgtgaaggtgacttcctgccttttgtccatctgcgcattcccggggtactgcaacgcattgctttatgttactgtgttatttcttttacagccctatttatgaatcataagttcatccccgcattaacctttatcttactagtaagttacactgtcatattatgcatggggaacggttatgcctgcgatgaaagcaatattttatccattattgacaggcaacttttcggcgaagcgcatctctatcaaaagagcccgattgatccggaaggatttgtaagcactctctctgctatcgcccacacttgtatcggtttttcatatggaaaatggataatacaaagccatcagacagaaaacaaagtactccgtttgttcttgaccggattcattctgataagtatcggctatttattggcagatgcgctgcctttaaataaaagaatatggtctcctacttttgttttggtgacctgcggagcggcttccatgtcacttgccacactaatgtattatatagacataaggaataaacaaaaatggtgccgcttcttcatcatcttcggcgtcaaccccctattcctctatgtattgagcgaagtacttgccattatgatgggaagtaccggatggaaagcggcagcctatgcagccattcattcaggaataaccgacgcctaccttgcctcagccgtctacgccctcgttttcactctgtttttggggggtatcggttatccactatatcttaagaaaatatacatcaaactgtaacaacagattcacaatatatagagaactatacagtattaaacaagaacatattaatcaaaaccaaaattaaattctatgctaaacgtacaatctctaacccaaaggacatttgcacagatagtagtctttgcattactcctattaaacagtacactggcatttgctcaaaatcaagttaacggtattgtcacagacaaaaccggagaaccccttatcggagtgaatgtagtcgaaaaaggtactaccaacggtgttatcactgactttaacggacagtttacactgaatgtagcacaaggaaagacactcgtattctcttacgtgggttacactacccaggaaattacagtaaaaggatcttctttgaagattattatggaagaagattctaaaacattagatgaagttgtggtagtaggttatggcagcatgagtcgtaaggatgtaaccagctccattaccactgtgaaagcagacaaactgaatgtaggagtttattctgaccctggacagttgctgcaaggtaaagtccctggtttgacggtagtacaaagcagcgatccgacttctggtactgcttctatctctttacgtggggcttcttctctgcgtaccggtgcggcaatggaaccttattatgttattgacggtattcccggtatgtcattaagtctgattgctcccgaagatattgaaagcattgacgtacttcgtgacgcttctgcaacggctatttatggctccaaggctgctaacggtgtaatcttgattaccaccaaaaaaggtagtaaaagtgagcacacttctgtaaactacagcgcatatcttgcatttgacaacattgccaagcgtttagatatgatgactgccgacgaactccgcacctatgccaaggaaaataacatcactcttccgaatgacaaaggagcaaacaccaattggaacgatgaagtactgcgcacagcaatcagtcataaccataacgtttctatcaatggcggttcagaaaagactcaatacagtgccagcatgagttatcaaaacaaacaaggtatcgtacgtggtacagatttcgagcgtttcggcggccgcgcatttttgcaaaccaaagcactgaatgatcggctcaccttagcctttaacgtgaatgccgcacaatcaaaaggtaccaccgttgattccgccaaagatggccaatccgtattcgacgccatgaattattattctccactagttcctgtcaccaacgcagacggttcttggtatagcgacaaaactatctcccaaaacttcaatcctgtatccatgatcaatgaagatacttttgaaaacaacaagaaactccttcaaggaacagccaaaggtactttagatatcactaaggacttaaaatggaacttaagtctttcctatcaagacgaacaatatatatggaacgaataccataccagcaaatcccaatataacacccgaaatggcgaagctaaacgtattgcaacagaaaacaagaaaaaaattcttgaaacatacataaactatgatcatacattcgccaatatccacaaactgggcctgatggccggttattcatgggaacagaatgatgacaatgacagtttcggtctggatgtctacgacttttacaatgataacaccactttttataatctgaaccttgccaataaaatggattggcagaatggcggtatcaccagcaataataacggtcatttggaaactttacgtatgatctcattttatggacgtatcaactactccttcaacagcaaatacctgcttcaagcaacaattcgccgtgacggctcctctgcctttggaaagaacaaccgttggggaactttcccatccgcatcgttggcatggcgcatgagcgaagaaaagttcatcaaagatttaaatgttttcgatgacttgaagttccgtgttggttatggtgttagtggtaactcactcggattcggagcttattcggctattcagacttacagtacttcaggttggttcaactatacaaacgccaatggcacacagaacagttaccataccctagcagccgcctcaaatgccaatccagacctaaaatgggaacgtacagccatgttgaacatcgggctggacttcagcttctttgggggcagattaggaggaaccatcgaatactatgacaagcgtaccagcgacctgatatacacttacgaggtttccacaaaccgctatcctttcggaaccatgccggccaatgtgggagatatcagcaataaaggtattgaatttaccataaatgccactcctatacaaacaaaaaatttctcttggcaaaccagtttgaacttatctcataataaaaataacgtagaaagtatatccaacagtgaatattccgtagattatatccgtgcagccgatcctgaaatcgcaggttattcttcaaatgcagacgtacagcgcatcatggaaggacatcctatcggcaccttctacacctacgaatgggccggctacaataaccaaggagtatccatcttttatgtacacgatcctgaaacgggtgaacgtacaggcgaaacgaccacagatcctgaaactgatagagaccgtactattaccggctgcgcacaacctgatttaaatttaggctggagcaataacttccaatacaagaactggaatctcgacttattctttactggtgtttttggacaagatatctacaacgccactgcagaacaatactctaatgtttcttttgtgaaagaaggccgcaatgtattaaaaagcgtagctaccgaacaccgtgctactgacacacaatctcaagcaccatccaatcgctggatagagaacggtagttatttccgtctgtcctcagtctcattgggatatactttcggcaaaattggtaactggataaactcgctcaagctatacgccacttgtaataatgtattcaccattaccggttactccggccgtgatccggaaatcaaccttggaggcttggaaccgggcatggacagacgtaccaattactatccgcgtacccgttcatttatgatcggtctaaacgtgaacttctaaccatataattgaaaactgatatgaaaaataacataaaattaacaacctggctggtaggtagtctgcttaccttctccgcctgcacagatctaaatgtggatcttaagtccacttataccgaatacccggattccgaaattgccaaggaagctaaaatggcaggtttgtattatggattcggcggagcattaggacgtcgttatatggaagctgccctgctgtcttccgatgagttcatggcagtaacatttggtggtaactggtatgatggcggcaactatatccattcctctcttcacgccagccttccaggcgacgcacacgtggactgggctggtgatattccggctgcaatcacaaaatgcaaccaagcaatttttgacttgggtggagaagatgaaaacaatgccgaacaggaagccttgattgctccggcacttgccatgcgtgctttctatcattttatttttatggatacattcggagcaactcccaaattagaccacttgatcggcgattctgaagctatcgaccgttctccccgttccgaaattacaaaatttatcgaaagcgacctgctccgtgctttggcttctggcggtttaaaagaagatgttgatgcttccacttatggcaaaccaaccaaatggatggctgaggctctccttgccaaactctatataaactgggctgtttatacctgtgatgatgtagctacttatgatccaagcatgactaattccaaattgaatgatgtcataaaatattgcgatgatatcatcgcctccggtcatttcgatctcagtgatggttatcgcaagaaattcatgccagacaacggctatcagattaaggatttcatctatgcaatgccataccaaaataatgaaacatcaaccagagccaatacttacgcccgtttccaattctggcctaaattcaacaatgatggtgcggacggtaaaggactgttcggcataacactatcccaaaatgccggaggcattttcatcgttactcccgaggcggcagaccgtttttgcctggaaggagatgaacgcaatgagatcatcatgaaaggtgcgatcaactattatgacatcagcacacatacaatgggaacagaaccttatatatacaacggacaacaagttgtcctcaccaagaacatcaccatcttgaatgaccaaatggatcttggaaatgacttgaacgcatggtgccagggataccgatgcatcaaatgggctattcaagcagacgattataacctctataaccgcaatcaaagcaatgatgtacctatcttccgttatgcagatattctgctgatgaaagcagaagctattctacgaggggcaacagccactaacggcgacacgccacaatccctattcaaccaaatacgcagctattgtaacgctccattattagagcatactccttcattaaacgagttacttgaagagcgtggccgtgaattttatgcagagacatggcgacgtaatgatctaatccgttttggaaagttcgaagacgactggggatataaaaatcaatatcatccggaagctcaaaccgaaaaatggcgtaggatctttcctgtatctgtcggcttgatgaattcaaacaccaactggaagcaaaattacggttattaataaattaaataagtttttataagggcttgttacagcaagctcttataaaaaactttaaagcaaaaaataattcatgaaacttcatcaaatcttattgcttcatattgcgacatctatcttggcattattcccatctcctatatatgcccaaaaaatgatgtaccaggactctatcgaaatcgtagtacacagaggagcgaaccatatagcgccggaaaacaccattccatcagctctagctgcattggaacatggagccggctggatagaagtggatgtgcgcaaaagtaaagacaatatactttataatctgcacgatgaaactttggaccgtactaccaacggtaaaggtcccattcaagatatgctatccaaagatattgaaaaattagacgccggcagttggttcagttctcaatttaccggcattcacgtaccccgtatagccgaaatgctagacaccctacaaggaaaggcacacattttttttgatgtaaaacgaggaactccgataaaagatttggttatattagtacgccaaaaaggatatgaaaataaaagcttcttctggtttgcagactctgaaatgctgaaagaatttatcagaatcgctccggaaatgaagattaaagtaaatgcctccaatatagcagctctgaagaaatggatgaaaatatgcaccccggcctatgtagaaacagatatcctcaatatcacccctcaattcaaagaattctgcaaaagcaatcatatcaagataatggctgctattcagaatgcgagtgaaaaagaatataaaaaagcgattgaagcccatcccgatttagtcaatctggaccggccggaactctttgtaaaaatgctccgtcaggagattaaaaaataacccttttccaagaagagccatgaaaagtaccctatcttatctgctgattctatgtagcctgttcatgtcttgcaccggacatcaggaagaatccctattgtcctatgtagatacccgtacgggaactgcaccgagcataacccataccgcaggacttttcggcaaaaataccgaagagtacggacagacgctgcctgccgtcctagagcccaacggaatgaacttttggactccccagacacaagatacagaaataaaatgcaaggctccctattattacaaagataagaagatacaggggttccgcaattcacattggattgtcggagggtgtacacaagattacggttccatgaccttgatgcctgtatcgggtacactgaaatatctcccccaagaccgaggaagcctgttctctcaccaagaagaaacagcaacgcctgcctattactccgtccttctcaaagattattccatttttgcagaaatgaccggacgttcccgttcagccattttccgattcacttataaccaaccggaagatgcttatctcatagtcaatcctaacagcgatgaaggagaaggatatattgaaatcgatactataaaaaaacagatacgcggatacaatcccgtacaccgtatctatcaaggctggggagcccccgccggatacaacgggtactttgtcattgaatatcaaaatgaaatagaggaatatggtacattccggtatgacagtctcttcgccggacaacgacagatagccgatggaacaggtataggtgcatatctccggttcaaaatacacccagaagaacccgtattaatcaaagccgcttcctcttttactgacatggaaggcgctcaaaagaatctggacaccgagatacctcattgggattttgaccgcacccggcaggaactgaactccatctgggaacaaaggctttcacaagttacagtacagacaaacaaccgaaacgataaagagaaattttacggagcactctaccgtgcctcattcctgccacgtacattcaatgatgtagacgggcgctacccttctttctccacaggacacccgttcagacaatcagccaacggtagaaattactatgaagattacagtatgtgggatacttaccgtgctctccatccgttaatcaatatcctgaccccaaagaaagccggagacatgatgcaatcattggtggacaaatatgaacaaggcggctggctgcctatatttccttgttggaacagttataccgcagccatgataggcgatcattgcatctccgcactgggagatgcctatatcaaaggaatccgtaattttgatatcaacaaagcttgcgaaggaatgctccagaacgcattcaagaccccctccacctatgaagaatacaaaaacggaatgggacgacgcgccttgaattcttatctgaaatatggatacattcctttggaagacagcgtaccggaagcctttcacacctgcgaacaagtatcacgtactttagaatatgcatacgatgatttcgtattggcccaagttctgcaaaagttggaaacatcagatgataactttcctgatccacaaaaaacagaactttatgatacactaatgatacgtgcacgatattaccgtaacgtaataaaccctggcaccggatatgcccaaggcagatacgctgacggcagtttcctcagcgataccggtaacgttttttccttcactcgcttcatcaccgaaggagctccctgccactatacttggtatgctccccatgatgtatacggactgatggaatgtatgggtggaaaagaaaaatacatcgccaaactggattccatgttcagcgaacaccgctactggcacggcaacgaaccttgccaccagatagcctacctcttcaactatgccggacagccttggaaaacccaacgcgaggtgcgtcatattatggaaacagaatatctgaatgctcccggtggactgtcaggtaatgatgatgcagggcaaatgtctgcctggtatgtattttctgctatgggattctatccggtatgtcccggtacaccttattatataataggaagtccttcttttccccggatgagtatccgcttggaaaacggaaagacattcaccatattagcccacaacgccaacaaaaaaaatatatatatccagtcagcaaaactaaacggaaaagaatatgacaagaattactttacacaccaagatataatacagggaggaacattagagttccagatgggcccgaaccctaatacaaactggggagcacccgccctcagcctgcctcccgacaatatgaaataagtacaaaaaataaaaaacaatccatatgaagaatcaaactatcatcagcctcttatgctgcctcctgttgtttgtgacaggatgcagtatttcccatcaagggaacacgtacgacatcatgacctatggagccaaaggagacggacaaacagatgatgccgccgctatacaacgcgccatcaatgcctgttccgctgccggtggcggaaccgtaatcattcctgccggacacacctttctatgcggcccgctatatttgaaatcctatgtgaaccttcatctggaacccaactcccgattgctggccaaccccgatgaaagcatctatacagaaagcgcattccgcgaaaaccgtggcgaaggaatgatgtggatcagtggaaaagacttaaaacaaatatccattaccggtacaggagaaatagacggaaacggaatcgccttcatgggcaaagagctggatgattcctacgagctgaagcccgtcactgattttgacccacgcccacatgtgcttacccttatcaatgtagagaagaccgttatccgtgacatcacgatccggaacagcgcctattggacaatacacctgataggctgttacgatgccttgattgacggcatctctttattgaataatctaaaaatacgcaacggtgacggtattgatgtggatcactccaaaaaagtacgtatagcgaactgcttcattgaatcgggcgatgactgcatttgcctgaagaatcgtcgggaatttgaagaatatggctcttgcgaagatattgtagtgactaattgtgtcatgacttcacgctcatgcgccatcaagattggctcggaaaatatggataaaattgagaatgtattattcaataattgcattatcaaaaacagcaaccggggcatcggcatacaaaaccgggatgaaggtactgtgagcaatatcattttctccaatatattagtagactgtatgttctattctgatgtatggtggggtaaagcggaacctatctatgtcacctcataccctcgtgccgtaggcaatcataaagatgcaggctggcgtttccccaaaggtgcaacgaaaggacactcgggagaagtcagcaacattttcttcaatcagattaaatgcactagtgaaaacggcattttcgtagggggagacactccggagaaggtgcaccatatctactttgatgaaatagatgtcaagttgttaaaacgtaccgattatgaaggcggtgtgtatgacaaacgtccttgtaacggagatggttttgtatatgacaagacttatgctttctatctggacaccgcttcggatatccggattaccggctataacatttattgggccttccctcaattgacacaagccggaggagaaatcaaaaagaagaatacaatacgtgtaaaaataaacaagaaataattatgacccacattccattcaaagtttctttgtttagactggtcttcctgctgctgcccgtgacggtcgcggcacaggaagccagactttctgattacgtagatcccagaatcggttcggaaggactgggacgggtatttatcggcccctcctgcccttatggtatggtgaaaccatcgcccgattgcactgtccatcccaatagtggttggctgcctatgcccgaacaagttaacgggttctcccaagtacacgtcagcgggacaggaggaggtcctaaatatggcaacatacttgtcatgccttttggcaaaggtatggatcagctcaatcatatagactatcgcaaagatgaaacaatccgcttgggctattatgctaccgaattccagagaacaggcatatatactgaaataacaactgctccacgcgcctcattctaccgattcacctatcccgaagattccttaaaatccctgttggttgacgccggcttcttcctgggtgaacaaccgacccccgatgcccgcgaagcacaacaatttgtaggttcggaaattcaaatcatatccgatcacgaagtaatgggatatacccgtattcgcggaggttggaataacggacgtgcctacaccgtttatttttatgcagtaaccgaccatccctttgtacaaacggccacatggaaaggaagccagatcagcaatgaacgataccagccagactcccaacaaaaaaccggagctttgttgcgtttcccttcttctgcaaataccattcaactgaaagtcggaatttcatttatcagttctctcaaagccagagagaatgtatggaacgaaatacctcattggtcatttgaggacacccggcaagccttattggcacaatgggaaaacttattgcaacgcattgatatagcctcaaatacacccgaaaaatataagcgtatgttttataccggtatctatcataccatgttaatgcctgtagaccgtaccggtgaaaatccattatggagtgatccggaaccttattatgatgatttttatgctatctgggacacctaccgcacctcaactccacttatcacactgattgaccctcaaagagaaacagacattgtacgttcactgatcaatatctataaacgggacggctacatgcctgatgcacgaagcggaaattgtaacggacggacacaaggcggctccaacgccgaaattgttatagccgatgcatttgtaaaaggactaccaaacatagattaccatctggctttggaagctatgctgaaagatgcgaccataccgcccggaggtaacgaagaagcggagggaagaggcggactgattccttatctggaattgggatatattccatacggtattccccgagccggaaaccgcacaatagaatactcctattgtgattataccatagccttagtagcaaaaggactaggcaagacagacttgtaccagcaatacttgaaacaatcttccaactggaagaacttgtggcgggccgattatgaacatgcaggagtcaaaggattcatacttccccgggataaagaaggaaactggttagacaaaatacctttcggaaactcccatatccagaaacccaccttcacatatactcccgttacctttgaaggtccttggtatactccttggtggaacatgttcttttatgaagcctcctcctgggaatattcactcagcattccgcatgacgtacccggactcattgaacaatgtggcggaaaagagaagtttgacgaacggctggatattttctttgacaagggtttcttcaatgtgaataatgaaccctccttcctcactccctgcctataccactgggtagggcgtccggataaaagcggcgaccgcatccatgaaattatccagaagaactataatgacggttctgccggtcttcccggaaatgatgactccggagccatgtcatcgtggttggtattccacatgatggggttgtaccccaatgccggacaagactattatttaatccatacccctctactgacagagagtcgtttccatttacaggaaggcaaaacattcacgatcaaagccgaagggctttccgaaaagaacaggtatatccagtcggtgctattgaatggaaagaattatccatattccaccatccgccatcatgatatcatcagaggaggcaagttggttttaaaaatgggtccccgtcccggcaactggggggagcaagctatttcccgaatctaaagagtaacgtatgatgaagaaaaaactttttatatgctttctgcttatcggcagcctgatgggaagcgtaatggcacaaggtatcattacccaccctctgttattcgtattcaaactgcatggacaaacccgaaagtaccagtttactttcagccagtccaatgacaccctttatctgcattggggaattgaaagaaacacccgatggcaatcaggcagttacgccatgccccaagaagctttaaaaacggctgccggactaagcttcttacaaccggaagacggacggcatatctgtctccccgctcaagagaccttcgccctgctttcagcaaccgcctatcaagaactgaaaagtcaaaaggaatttcactataatcaaacagaataccggctggctgatacgaagtcacaagccatggggtaccccctgctgcatgtaaacgactcagtagacggatgcgaaatgtggattatggacaatccggatttccctctgatatgggagatacaaaacaatccgctcggcatcaattggaaggcagtccccgtaactctccctgcacaccatctgaaagaagagatcatgcaaagcccggaaaagatgggcagtatctattatgcttatcccacgccagacggcatacggactccggcacccgaaggttacagccctttctacgtcagccattacggacgccacggttcccgctggatgacttcggacgaacgctatctggaagtcattcgtgtctttgatacgtttcacgagaaatcaggacttaccgctttaggtgaggatgtccggctcagacttcagaaagtatgggaaaacgcccgcggacgtggcggagacttaacttcattaggagaacgacaacataaagccatagccagacgactgtatcaacaatacccccaaatattccgggacagtgcctgcatatcggcacgttccagcacctccgtgcgttgcatcatgagtatgtccgcattctcggaacagctgaaagagctcaacccctccctccggattacccgtgaagccaaccggagatacatggactacatagcctacacttcaccggaacttgaagagttcagttcggacagtgctgcatggaggaccggcttccgatgctacgaagaaagccatattcgtccggaacgattgaccgccacgctctttacgaatccccaagaagtgaaagaccctcgcggacttatgatgggactctactggattgcatcggatatgcaagatgtagagttaccgctttccttctacgatttgtttgaaaaagaagagctgttcaacatttggcagtccatcaattaccggatgtatatctgtaacgccaatgctccgctcaatggaggtgtagctcccgaaagtgcaaaatctttattgaagaacattatagaaagtgccgaccacgccattcgcaaaggaactccgtgcgccaccctccgtttcgggcacgacaccaacctgattcgtctgttggcactcatgcaagtagaaggatgctccaatcaagagacagaccccgaccggtattacctggcctggcaggatttccgcatctcacccatgggagccaaccttcaattgatctttttcaagaacggacaaggagaagttattgtaaaattgctacataatgagaatgaggtaaagctacctattgacagccctatcgccccttactatcaatgggaagcggtaaaagcattctacaatcatttatagacatacaaattgagaaacagcaactttccttcaaagagtcaatcttcctattagctaaggcttttcttgcctacaattaagccctttcttacggttacctactacagtctccctcaatggactatagagtccattgagggagactgtatggtccacccaagcggaccttacagtccactggcggagtctgtagtaggtagccgtaagaaagggcttaactatatggaagaaacggcttacataaccgccctattccggttttatctttttcagataatcagaaggagccataccaaattcatctttaaaacactgacggaaatagactgtactgttatcgctcatgtcccacttcggtatgcaaatgactcagacattcgagactatcgaatattatacttacggtctgatagagaattacaacggccgtaaccacagtaccgatttggtcatctattgtcagagcgtagacgagctgttctattcctacatccgtccgcaggaaacagagaccaagacctatatccgctaatggaagcagttgaatgccacaagcaaaggctggaagtgatagccgttgctccgttctcagcttcccccctgcacacatcatctattcactagacgagaggtcaaaggataaagccactcacccaaagtaaagaaggccgatctcaccaatcatagataaggcacagatgggcttgaggtatgtgaacagctgggacagaccgccactcgaacagtacatgttgccttgcggtgattatgagttccccttcatcctgactccggtcaaacataacgtatatctggaataaaaacgggaaaaattaaaaaagcatgggagagttccccgataggatgctttcccatgttcttatataagattagaactgagtttctaaatagtatcaaaataccaattgaattttctttataattattcctttgtctttcagctgttccacaggatagatttcatcacgcaaggatatttgtacaaaatctatattttcccacttcagcggcacattgtcattgtctcgggtagatgcgggataataatatggagtaatacctccaggatattcttgaggtagaataactcccttggttggccttagagctgaaacgggaataagaatctgctgcatgtcgggcttgatagagaaggtatttccatagccacggccttccgtatcaataaaattgatgatagctttgtctgtattagtcagtccttgtgcttcgattcggatgtacttgggtgtagatgtcttccaatcgcgactgtcgataaggggagatatgtatttggatagggtgacatcgcaaggtaatttgtaagtatccttacgctctaggtcgggagtggtgatccggaaggctttgaccatctcatcgcctacatagacctgtgaaacttggttgtcggggctattgtgtggtctgcttcgcctcagttttcttatattgtcattcttgtccaaaagggtgagggtagtattattattcacgatgcgcagattgtattgctcctgttcatagtagccaaactcgtcggctgcgccgatgatcttggcgggaaatagtaatttgccatcagtatattctatgccgaagtgatagccaatttcacctaatggatacttgcttaggtctacttctgtctcataacggaaaccactcttgtgcgccatggggatgcgctttccacctctccaacctgacagaatgtaaagattgacttgtttgggcagtgtgggaccatacacctcacatgcgaaaacgcctgggcgactttgcggcatttctgtcaacgtggagttgtttactttccaatctttcatggcttccttattatagtattcctgattgggaagtgcttcgtagtttactaacaggttgttcttgaatgtatatttaccgggatatatgcaaagtgctgtttgtaaaccaggcaattgaatgtggatgttacgattgagacaaacggcctgacgggcaacccggttcacgcttcctgccttgaaaggatcgtcaacgttcataatgtcgggataaacctctaatttccattcgttatcggctaccttgtcaatgaaatagattccggtaccttcatattgtacaacgggagatgaccccacaccagcaatatgtttcagggctttcacatttttgggttggtcggtggtattgttagaatagtagaacatgtcctcggcattcagctgtcccaaatcttggtaaaagtctaccttaaagtctccgaaattgttattttgtggatagtatccataatgcttccctctgggtatgcgtttcatcacttgagccgaaatcataccgccgatagctttggatggggtatataccatatttagaaaatgtgtttgccagcttaaattgcgtgaagctgtttgatgttcatcgtaggagaacatggttgcaaactgtatgcctccgcgcctatactctcgtgtcatggcaggcaataagtagccgttttccgtgtccgttgcatcaaattcgtacacaaggcggctcttgcctttcagcccatcttttaccagaggctcatatctgtctacaaagtgcaatccgttgtctatgaaacgatgtccgttattcagtgcttgtggataccaggcgtaggtagctccgtctaccatagatttctgaatggctggcgctacatcgaaattctgactcagattgtagtatatcagctttttacatccagtgcttttgatagctttacacatgcaattgatgtatttcaccatgcctggaatatcattaggaaactgtgtgggttcgttaataatttctacatagatgatattgggttcgtccttaatacagcgtcctgtataacggttgacatggtttaagatgtccgtcatatagtttatctgacacttaattgccttttcatcgtgtatcaatgtgtttttggcaaaaagtttagcatagccggtattggagttgtcattcatttcgggaaactgtgaatcgtacgtcacaataggcgagaaaagcatgtagatacctcgtctgctggcttcggcaattagataatccatcatattcaagtggtcgttgtctatcagatgcccgtcaggatcagaattctgaaagtctccccaaaagcagatgcgcaaggcatcccatcccatgcgtttaaaatgatccatgtcttcgcgaaccatcgctttgcggtcggcgtttacatagcctgccgcacggtagtcgcatgatgagggcagacagtaattggcaccgaacaatgccacttcctgattattttttttccagcgaactatgccgtctttatcttgaaagaccaactcttgcgcttgaagtacaataagtagactccatgcaaataatactaaaacagatatttttttcataacagataagtttttgatacgttcacaaacatacttgttttttctacattgggatcatatccaatagacaatttatagcacataatttccatcttttttcggcttttagatttctttaatgctgtcttttttgtgttagcatctgtcctaaatctccatttgcaatactctctggataattacatttgcattcatcaaatattaattattaaccaaattaatttaagctatgaacaaacaaagaatgcttggcaaaagaagaattcaatattttcggcttttgcatgatgcaaaacaatcttctttaagaaggacctattcattaatggccctttgcctgttctgtgtgatcaatgcattcgcacagaatgtaaaagtaaccggtagagtaaccgatgaagcagaggaagccattatcggagctgctatcaaggtagtggatagcacaatcgggactatcagcgattatgatggcaacttcgtattggatacgcctaagggagccaccattgaggtctcttatgtgggctatgcacccaagcggatacaagttacagagagcaaggcttatgcgatcatattaaaagaagatgcgaaattgctcgacgaagtgattgtaaccggttatggtgccgtatctaagaaaaatctgacgacttctattgctaaagtaaaggccgatgaggtgaataaggccgctaccagcaacatgtcgcaaatgttgttgggacgtgcagccggtttgcaggcaacggtggccagtgctcagccgggtggtggtatcaatatttccattcgtggtgcgggtgcgcctatctacgtggtagacggtatggttatgccaggatctgcgttggaaggtgacagcggcggaagtaccactgtaatgccctccagtgtaaaccgttctggtttggctggtctgaaccccgaagacattgaatccattgaagttttgaaagatgcttctgcctctatctatggtatcggcgcggccaatggtgtggtattaattacaacgaaaaagggtaaagaaggtaaagtgaaagtgacttacgacggtaacatatcgttggtaaagaactatccatacctggatatgctcgatgctccttcctatatgaaatatgtgaacgctttcggtcgtgaacagtatatgcacgaccataacatgggagcttacggctctgctgcctatgacaacggttttcctgatgttttctcagacagcaatattgcttcagcgaaaaccacgaattggcgtgaccttgtactgaaagacggcagtatatccagacacaatatcacagtacaaggaggaacaaaaacattgaactactacctctccggcaactacattcagcagattgggtctgtctctaattctgaaatggaacgtttcactttgcgctccaatgtttccgcacaacttaccagcttcttgaagttgactacggctttcaatattaaccgtaacatctatcaaaacggtacggtgggtggcgcttccaacagtcgtggcgaacaggcttccggtgctttggctgctgccatgtcctacctgcccaacatgccggtacgtgatgaaaatggcaactatacgcttttcaaggttattcctaaccccgtggctatggaagatatacagaacgagtccaagaacaatggatataacgtgaacttcactgttgatataaatattattaaaaatatgttggccgccaagttcctgttcggctataataacgaaaattcagagcgcaacgtctacattccttcggatatatactttgaccagatgtataagtcgagaggtgccgtaaaccgtaacgaacgttacaacactaccatagagggtaccatcagctttaacaaggcatttggcgaaaatttccgtatggatgccgttgtgggtatgggccgctacttgaataaatatacaggtatggccgtaagctatacggacaataacgacattttggctaatgacaacattggtgcagcagctggaacatttacgcccacctcttatcatagagaggacgaaaaacgttcgcaatttgcacgcgccagcttcgacctgttcgacaggtatgtgatagcaggaactctgcgtcgcgacggcactgacaaatttttcaaaggcaagaaatattgctggttcccttctgtatctgtagcgtggaagattttcaacgaagagttcatgaaaagggtagaatgggtgaacttgctaaaattgagagcctcttatggagtgacaggtaatgacaatctggggtcctcgctccatggttcgtacgatgcctttggcactcatgttatgtttaacgaaaactctgtaaaatacattccctattacctgaaaagtcaggattaccctgacgtaacttgggaaaagacagtaatgaagaacatcggattggacttttctctgctgaacgatagggtaaacggtagctttgactacttctggaacgacattacggatatgctggggtatgccaattcaaacggcctttccatgtttggttcttatcccatcaacggtgcacacatccgccgctatggttgggatgccactttgaatacggtcaatgtcacaacaaaggacttcaagtggacttccgtactaaccttgtcccataccaacgctatctggaaggaacgtatgcctaatcatacctacaacgaataccaaatacgtaaggacgagcctgtaaacgccagatactactatcgtacgaacggtcttgtgaacttagacaagagcaacatgccttcttatcaaccggaagcataccagaagccaggttgtcctattatcgtagatttgaacggtgatggactgattaccgtggaagacgtggatatgaaaaacgtgattccttctctctactggggattcggcaacacgttcacttacaaaaactgggatctggatgttttcatttactcgcaactgggtgttgacaagtacaacgatgtctattcctggacaagcggtagaggattgggcaatcagacgaacaacatgtccgtctacatcaaggatgtatggcactctgagctgaatccgaacggtaccattccgggtattgcgtatgagatggcttctgtatctttgcccggtggtgccggaacagatatcggttacgaaaattcctcatttgttcgtgtgcgcaacatcacactgggatataactttaaaccgaaccaattgggcgcattgagtaagcttctcagcggcattagagtttatgtagatgttcaaaatccgtttactttcaccggctacactggtctcgatcccgaagtgaatacgggtggcaattacaagggcggtaaagctgaatatccgcagacacgtacattctctttgggtgccaaattatcattctaactttaataacatactattatgaagaaatatatttatctctcgatccttacctgcatactcacagtgttcgggtgtgaaaatgattttgatgccaagatatatggttcactttctacaacaaattttcctcagtccgaagcagactatgaaagctacatgatggattgctacatccctttcaccttgacttgggcttataattggggtagcagcaaccagcacaacttctacgtggccgaaggcggcattaaccgtatgcttgacacgccctccgatatatgtgcaccttggaccttgggcggttcatggggtggtccttgcatctatatggcacaaggacagtttgaggacatgaagtatgccagtacttatagtaatattttgccttctcactttgacaaggtacgtgatattacccgtatgacaaagattataggcaccttggaagaaagtacccttctttctgataagaaaaaacaggaattgatggctgaatctcgtcttctgcgtggcatgacgatgttttatctgcttcacttctacggtcctgtgccggttatccttgatccaacgctggtaggcaatcttgaagcagagaagaatatggtacgccctacgttggacgagatgaccaaatatatcacagccgatttggagtatgctgctgagcacatggtagagacacaatcggaagtgggacgctacacggccgattatgctcgtttctgtctgatgcgccattacctgtgcgaaggtgcacacatggatggatattatcagaaagcctacaacatttaccatcagtttaccggctcttactcgcttttcacctcaggtaagaatccttacttggaccagttcaagatagccaatgagtttaactgtgaaaccattatggccgtgtcttgcggttcggatgccgacggcagcggtaagcgaggaaactttaaccccttatcttggtacttgcttccctacgatgtatccaagtatgacgataaagggaatcccaccccgtttgtcaatcaaggtggaggctggggacaatattacaatgtagatcctcagttttatgaaacattcgaagaaaacgacatgcgtaaagagggtatccttacttcttattacagtgcttggtatggctgggtgacaaaggaagatatcggtgtgaaatgggacggttacattttgaacaagtatcccattgaaacggaaacagctttccagggtaccgattatccgttggcccgttgggcggacgtgttgctgatgtatgccgaggccgatgtccgtctgaataaaacggtttccacttctgctatcgattgtgtcaatcaggtacgccaccgtgcagggttggcagaccttccggcagagaaaactgcatcagtcaatgatttcttagatgccctgttggaggaaagaggtcatgagttctactacgaaggccatcgccgtatagacctcatccgattcaacaagtactatactatcatggatgcgattggctgcacaccgacatcacagtacttccctattcccaactacgcagtagatcaggctactgatatgggatatactttaacgcaatacttcacgagacccgattacgacgggcctcaaagataaagcaggataaagtccgacaggtcagtggtaaagattgttttatgggaaaggggctgtccggcaaatggacaaccccttttatagttctataccggacatgtacggctatttttctgatacaaaaatccgaatcttaaaactgcctcctgttgtatctatcttgccgacaagtttgccggtaatcaatgaagataacagtctactgtctgtaacaatggtaggtctggtgtatcctttgggagtatcgcttgtcacttcattgtttatataaatgcggcagctgtcttcattttgatcaatacctttcagcatgtagcgtgcagagagatgggtacttccatcgggcaggacagtctgcgtatccacagttcccggcaggatgtttcctttaaaatattcaccttctgcataaccagagaaactgaccatattgacaagaacagaatcattctcgacctgaaagatattacttataaaaatgatcagtgtcaatatctctttcatagcaaatgctttataagaaaattcgaggctaaatcggcaatttcttcgatatgtcgggagaatccatggtcgtattcttccatgagatgcaactcgctgttcttccagatgtttttgtaacgctcactataagaatagggagccacacggtctcctgtgccgtgaattagaaaggctgctccttggtagcgaatggctgtttcataaatgggcagacggaaagctgtcagaatatactccctacctaatttgcggcctccgggaagctcgacatattcgggcggattaatggggttgtataacaccccgaatgtatttcctcgtatggcatcttcacgcaacacagctgcaggtgccaaaagagtgaccgccgaaatggtgtcgttcatttcacctgctgtcatacttacgactacgcctccttgcgaatggccgagcagtcctatcttgccgttgcacccatctaattgcagagcataacgtacgacacgtttaagatcttctatctcgttgggaactgtcatatccttaaagtcgccttcactctccccatgcccgttaaagtcgaaccggatggaggcaatgccgtgcatctgaagagagtctgataccaatttcattaattgccagtttttgtctcctccgaacccgtgggcaagaatggttatagggcattttcctgttcccttattttcgggcatttgaacttctgcagcaagcagacctctcgcaccgggtatcaagacttttgtcactctgttttgtgcaacagcacataggctcattgaagcgcacaataatccaagaagtattcgtttcatcataataactgttcttttatggtgcgaaaatacaatatagataacacaaaatcaagcaaaaacaacggattataaacagaagtctgtttagtgtcatcgtctgtccaaaatcttcatcgcttatgattagagaactgttacatttgtctccaagtttattgataatttcaaaactgatttactatgaataagaaaaaactgattatgtggttgtgcattttgtgctgctgcgctactttgagtgcccagtatggcacgcttacttcgcccattgtgggcaatgacgactctgtaacatttcgctactatgctccttatgccaaaagtgtattggtgaacggacagtttatggtgggagatattcccttgataaaggatgacaaaggtgtatggagtgtgacagtgaaacccgaaaaggcggatatttatccttataactttattgtggacggaacgcgtctgaacgacccgggtaataaactgctttcgcccaccgatgctttcaaatccagcttgctggaaatgcccgatcccgatgctttgtatactatcaatccggtgcctcacggcaaagtgcactattgtacttatcgttcgcacgtgttgcagcagtatcgcacggtagtaatttatactcctgccgaatatgacctttctgccggcaaaaaatatccggtattctatttagtgagcggaacgaccgattcggaagagtcatggtacaagacgggacgcgccaacacgattttggacaacctcattgctcgcggacaagctgagcctatgattgtggtaatgccttatggttatatgaacggcggtacaccccgtcctcacaccatggaggccggtgagatgtacaacacctttgcccgcgaattgacggagtgcgtcataccttatgtggaacagaacttccgtacgataaacgaccgcgaccatcgtgccattgccggcttttcacgtggtggcggacaatccatgtttactgctttgaagcattccgaccggattggttggatgggatcatatagcgcttacctcactccacaggtgatggaaaaatattttcccaacctaaaagaaaaggccaatagcctgaacatgctgtggttttgtgtaggcaaagatgatattctctacaaggaagttatcagcaatacgaagtatttcaatgaaaagggtattcattatgagatagacgaccgtgagggagcacacacttggatgcatgcccgttattgtctggccgaaacttataagaaattgtttaaagacaagaaagagagtgagaagtatcccggcattatgattgatgccagcactcttcctggattcagtgttttctatcctaccaatctgaaggagatggtggccaagcagggacggttgccggtatacattcatggcaatggtgcctgtacgcactattcaggcgattatcaaccgatgtttgtcgagatggtgaagaacggctatgtggttatctcggtaggtgcggtagacggagatatcacagtcagcgatatggatgataacctgctggatgctgtcgattgggtttgcaggcagtcttccacttccggcagtgatttctatcagatgattgaccgtttcaagattgctgtgggcggacactcttgtgggggcgcacaggccatttccgtttcttacgatccgcgtgtttccactacgatggtacttaatgccggtatgggcaatattgaaatggcacatgctaatgccaatagcctgaagcagtatcataagccggtgatttacctcatcggagggcctaaggatatagcttacagcaatgccaatatcgatttcgaatccatcaatcatgtaccagtggtttcggtgaacttccctgtggggcatgccggaacctacaaacaacccgaaggtggtgtattgggcaaagtagcattgatgtggctcgattggcagctgaaaggtaagaaagaagcatccagattctttcttgatgccggctggcgcaagaaaaatttcccggaatgtgactttaaatccaagggtctgaaataaaatgaaaggatgataggagagcgtgggttctaacagatagagggtgttttgtaagcagtatacagcttcacgtgtaagatgtatactgcttcacaggcagggccacacacgtgctttggtatagttcaatgcctacgatagtgtaagccaacacgtactaatgcataagctgaaacattactatgtgtagcccgagacatgctaagacaatgtaaacctggcaatctcaacatgtacgctaaacacgccaagcaactaatgatgttccaggtatgaatataggaataaagtcctattcttgtttcatccctaagtactccatcggtgtcttgccaaattctgccacgaagcaacgggtgaagtaagaagcattggaaaaacctaccatatacataacttccgccacggaaaagtttccattttggaacagtaaggcggcttttttcagacgaatggaacgaatatattccactgtagacatgccggtgagagactttaacttcctgtaaagctgtttctgggatatgcccatgagtcggcttagcatctctaccgagaggtcggaattgtctatatgctcttcgatgattgtggtaattcggaataacagcctttcatcaatggatatttcgccctttagttcgggttgtttgatatgttcaatgcgcatctgttgctccaatttttttttgtttccaagcaattgcttgatgcgtgccacaagaagcgagctatcgaatggctttgcaataaaagcatctatgcctaattgggcactttgatattcaataccagagtcattcttggctgtcagaagaatgatgggaacagtggcaagcggcatgtgtctgcggatgttgcggcacatttctataccatccattacaggcatcatcacatcagcaataataagatcgggcaagagattaatgcaaagtttcagaccatttttcccattttgagctgtaacgcatcgataatccgtacttagcagattgcttataaaaccggaaatagaggtgttgtcctctacgatggcaatcagcggacgtgtatcttctttgttttctgttgtggtaggcttttcaatgatttcctcttgctcctgaatgtctatgttgatgggaaatgttaattggacagtggttccgttggaatcggatgtgagaagcacggtgccgttatgcatctctacatattcctttacgatggcaagccctatgccggtgccctctttgtcatttttgatagtgcgcgaggattggtagtaacgttggaacacgaggggaatctcctcttctgggatgcccactcccgtatctgccaccttaacatagagatgtttggcctgttcattatactccagagagaacatgatgctgccatgctttggggtaaacttgcatgcattggccagcaggttgttcaggatggattccattttaaagatatccatacgagtataaatgttctctcgattagtatcgaaaacaaaatccagctgcttgctctttatattctctcgataagaattgaaaatgcagcgcgcgaattctacgaactctatttcggtcggaatgaaggtttgctttatcttttctctgtcttgataagcttcaatagtgaaatggataagcgaacccagctttttggcattttcgtatattaattccaacaatgctttcttttcttgttcggtctcttcactcagcagtttgctggaaggagcaatgatgagacttaggggagacttgaattcatgggcaatgttcgtgaaaaaatctatttttgacttggcttgttccatgaaataatttttcaattcccgttctttgcgcagttgctgtctgataatgatgaaacgcaatatccaccaaacaaggccaataactaccaagaggtaaaagagataggcataccaagaaagataccaaggtggtgtgatggtgatgtacagaatagcttctgtctgcttattatctgagatgttttccaaggaacctatgtataaggtatagtctccaggtgaaagattagggagtgtaatggagttttcgttcctattcagttctatccattgtgaatgatatccatcgagtttgaaagcatagtttgtcaaactttcacctttatactgatagtcggagaaagaaattctcaggttgttctgtttcgcagtaagccggatgtgcttgctttgccggtcggtatagcttagttcctcattgctattaatttcaatatcggtaatctttactttctgggattgttgtatctcttgcctcagcagtatgggatctatctgagttatcttattgctcgttcccaaccataccttgtgatcaattcggtcgtagaagatgtcaatgtatttttccgaaatgcggatacggtgtactttcaaactttccttctccactataaagagtccttcggaggtagtgagccatatctcattctccccctcatccatggcgaatacttcggtagacagcacacggctcaatgggatactttgtgtgctgatgtttcctttgtttaccgatagtttcagcagattgtctgaagtgcttatccagatatttccttccgaatcgctgatgacagcgtaggagtcaatgtggggaatgtcagttatcttctctatggggagtatagtaccggttgtcaagttgatgcggtcgatatgatgattattggataatacccacagattgttttctctgtccaatgctaattggtagatatcgttgctgtaaagcccttgatcatgggtaaagtggtatttgaccttcagaatgcccccttcaggggattgttcgctagagatgccataaacaccgcaaaaagtagccaaccacaagtcaccattgggcgtttctaatatatcgtacacccaatttttgaggtcatcgaagaagtaagagatgaactgttcgttcatcggattatagcgtagtaatcctccgtctgaggctacccataggtattggcggctgtcttcatagagtgcacgtatacggttgtgcggaagggaagattctttggaactcatttggtaccaccgacggatattgttgccctgcatgtctgtttttaattttatcagccctcggcttccacccagccaaagagtactgtcgaccgtgcgctgtatgctggatatctggcaaccttcatcggaaccagtgatgtcgaacaacgaacgggatcggatagaaggattgtgtgcggctaaggagatgccattgtcggttcctatccaaatattaccattagcatccttgaagaacatattgactacgttgctggacagggattgactgtttcgtgcatcgtgtgaaatcagatgccaagtgccctgtctgtcgcatacgtagagtccgttgtctgttcctataagcagattattatcatctttagcaatactcttcacaacataaaaatctctgacgcgttcgatttccttggtatttaggttcatgcgatgcaaatgatgggcattacctatccacaatgtgctttcagagctatccaacatcaaggtagaaatgtagaaaaactcagggtgggagataacttggtaatcgctggtggcaaatgagtaacaccccacttcgtccttcatgccgatgtacagattcttttggtcggtggcaagcgattggatgttgcgtggaaaatcctttccgcggatgagggcgggccgcagttcatcttgttctacattataaatatagagccccgattctgctccaatccagatttcacccttatattcgcagaaagaacttatcgactcgtttaaccgaatattaggcttgctgaactgtccgttttgtaaattaaataaagtaatgccattttctccgcctaaaagcataactttgtgatggataaaattgcatttgacgagttgatgtgagggaagtgtatctgaaacataatgacgtatgtcatagccatcgtaactatacaacccgcgtgaagtaccgaaccagaccatgcctgtggagtcttgcgtaaaacatcttactgatagtgtcttggtttttgaacccagattattgaaacctccattcaaattggacagattgtctgcccacagatggcaggtaatggagcaggtaagtagtattaaagttaaaatcttcataaggttatttgtttactaagagcaaattaacacatttttcccggatgagaaaaatgtccgacgggtaaacttcagcattgtcctttttgtgttatagaatgttctatctggtctgaacaaaagagtatgttctatctaattttgtcagttagaaaacatgtccttgcatttattaatcttttaaattatagaaccatgaagaaaattacgcattatttggttagtatgctctgctatactattcttctgctgactggttgcacaagtaaacagcagccttattgcatcggggcagacatttcgttcgttccccaaagtgaaaaggggggagttgtatataaaaatgtagatgggaaagaaacggatatttgccagatcatggccgcccatcacttcaacaccattcgtttgcgcgtctttgtcaatccggaggccaaagaaggatacgctcccgaaaaaggatattgtgatttgaagcatactcttgccatggcccgtcgtatcaagaaagcaggcatgaagtttgctctcgacctacactatagcgatacatgggccgatccagacaagcagttcaagccttccgcttgggaaggaacaactggtgcggagttagaagaaaaactctactcctataccaaagatgtgatgattgctttaaagcaggcagaggtagctccggagatagtgcagataggtaatgagataaatcacggcatggtatggccagagggcaagttggatgacaatgctacagaagaaaactggcggtcgttgatggaactttacaaagcaggccagcgtgcggttcgtgaggtattaccggaatcaaaactgcaagtacatctcgccttgggcgggcagaaccggctttgccgtgagttcctggatcgtatgattcagatggaagccgaatttgatattatcggactctcctattacgaacaatggcacgagacttacaatgatttaaagtccaatctctatgatctgaccgaacggtatcggaagccgatatgtgtttgcgagtatggtgccaataagaaaaacattaagatgatcaatgatattgtacgctccctgcccaacggattgggttatggaactatggcatgggaaccgacgagggtcttgttcgataaggaagggaatgctgataaggatctgttcggcatatatgatgccttgtacaaacaatacataaagagtgatgtccaacccgtttatgaacctccttatgtaaatacggataccattcagaaacccattatcggtgcggatatctcttggcttcccaatcaggaacaacgtggcattgtcttctctcacaacggtgtgcagaaggatgcattgaaaatcctgaaagagaacgggttcaactggattcgtctgcgtctttttgtggaccctacgacagaaaagggatattccaaagatggtttttgtgggttggaatccactctatccatggccaagcgtataaaggctgttggcatgaaattcctgctcgatttccactacagcgatacatgggccgatcctggccaacaggcaacacccgcatcatggagtaacatccatggctctgcactggaaggaaaggtttatagctattcaaacgaagtcatcaaacgtttcatggccgaaggcgtctgtcctgacatggtgcaagtgggtaatgaaataaataatggcatgatgtggccacagggtaagataacggagacgtatgaaccctttgccgttctgttgcgatgtgctacggccggtgtacgcgccgctaatcctgatattaagattatgattcacattgcttgtggcggacaaaatgaaaaatcggtgaagttcttcgataaaatcatcagtcgtgatgttaagtttgacatcatcgggcagtcttactatccaaagcatcatggtacgttgaaagagttggaaagcaacttgaacgatttggccatccgctacagaaaacctattgtagtggtagaatatcaggaatttcgaaaagaagtgaatgaaatagtctcacgtatccctcacggattgggtttaggaactttcatttgggaagctacttcaccgatgtggggcgagctgtttgacaagaatggaaggacaactgagtatataagtatttatcctgagtttttgaaggcatttgctgataattaataatcctataaataatatgaagataaaatttttatggacgcttttgacaactttgttgattgcttccagcatgtatgcacaaaggccgatacctgaaaatacaatggtttcggaaacggccctttttaagagagaatatcctcgtgttgacaaacagaagcgaggttacttccgcctctatgctcccaaggcgcaggaggtatacctggtatgcggaaaacgatatgacatgacaaaggataacgacggatggtggtatgtcaccacttctcctttggtcgttgggcttcatttttatcactatatggtagatggcatgacggtgacagacatagagacttatacgtatggtggcagctatggacgctccagtgccatcgaaatacccgaagggacggaaggggactactaccgtccacaggagatggcgcatggacaaattcgttcggtggtctattattctaccgtggagaaacaatatcgtcggtgtcatgtctatacaccagcagaatacgagacttcgaaaaagaaacgttatccggtgctttacctgcaacatggtatgtgcgaagacgagacaagctggccgatgcaaggtaaggtgaactttattcttgataacctgattgctgctggagagtgcgaaccaatgctggtcgtaatggataagggcaattgcagcattcctttcaagcccaagaaaggagaagatataaacaaggcaagagatgcattcggctccatttttccatccatcctgttgcaagatattattccgaatatagaaaagcagttccgtacgctgactgatagagagaaccgggctatggctggtctttcatggggtgggcatcagacctttatgactacattgtacaacctcgacaagtttgcttatatcggctcgttcagtggtgccatatttttgcgtgatggggattataaaacagcctataacggtgtgtttgccgacagcaaggcattcaacaaaaaggtccgcacactattcatcggcattggcagcgaagaaaacttcggcgcacagaagatgagtgatacattaaccgctcttggcattaaaaacaccttttacgaatctccgggtacagcccacgagtggctcacctggcgtcgttgtttgaaggagttcttacctttattgtttaagaaataaataaaaatgtcaataatgatacaaaataatatgagtgtaaggaagaataaaaggcaagcaagaaaatatccgtctacagattttttgcttctgctctgtatcatgctcttttgccggtgcagcattcaccaatccaatgaacgaattaatttggaaggtacgtggcgatttgcgatagaccggcaggaggtagggatatcggaacaatggtatttgcagaaattgccagactacgtacaactaccaggatctatgctgagtaatggaaagggagatgctgtcaacttgggaactccttggacaggaagcctgttcgacaaatccttttttactgaaaagaagtttaatcgttatcgccaatcggacaactttaaggtacctttctggttacagccggaaaaatattatacgggggtggcatggtatcagcgtgatatcgacatccctgccgggtggcaagagaaagccattcgtctgtttttcgaaaggtgccattgggaaagtcgtgtatggatagatagtgtggaagtggggatgagaaacacattgagtgctcctcaggaatacgatctgacaggtttgcttactcccggaaaacatgtgattactgttcgtgtagataatatgatacgagaaattgatccgggggaaaattcgcatagtatttctgaccatacgcaaggaaactggaacggtgtaacaggagaaatgtttatcgaagctaagtcgcccgtctattacgaggatattactcttttccccactttgagcaaaagcgagttaaccgttaaaaccaatgtgcgcaatgttacgggcaaacagcaggaagtgaactttttcttcatgttagaaaagaaaagaatagaatataaacaggtgatgaagccgggtgataacaagttggagtttaaaatccccttgtcgagaaatatgacttattgggatgaattccatcctaatctctatacgctgcattgtgggctacagggattcggaactattacagatgaccgtcaactcacttttggttgtagggaatgggaagtcagagaaggggtgctctatttgaacgggcatcccgccttcatgcgaggtacgctgcattgcgcttccttcccattgaccggttacccctctactgacaaggaagaatggttgcgtgagtttcgtatttgtaaggagcatggtctcaatcatattcgttttcactcttggtgtccgcctgaagctgctttcgaggcagcagatgagttaggcatatattgtcaggtggaatgctcttcttggcccaatcagtcgagtagcatcggggatggcaaacccatagacgctttcctacagacagaagcagagtatattgtgaaagtatacggtaatcatccttcgttctgcatgttggctcttggcaatgagcccggaggaaatcataagcagtatctcaccaactttgtttcctactggaaagcacgtgacaaccgacggttgtacaccacagcggcaggttggcctaatattcaggaaagtgatttcctgagtgattcccaacctcgtattcaacattgggaggaaggattgggcagtatcattaattctaaagaaccttctacagcatacgattggagcgattatacagataaattcaatcaacctttcatcagctatgagatagggcaatggtgcgtataccccaatttcaaggaaatagcaaaatacacaggtgtatataaggcaaaaaactttgagatatttcaagagagtttgcgggaaagcggaatggaagcgttggcagatagctttctgttggcttcaggtaaattgcagacaatttgctataaagcagatatcgaagctgctttgcgtacgtctaatttcggcggattccaacttttgggattgagcgactttaccggacaaggtacagcattggtaggtacattggatgctttttgggaggagaaaggatatgttactcccgaggagtatcggcgattctgcaacagcgtggtgccgttagcgcgtattcccagattagtatttgagaatgatgaaaaatttgttgctcagatagaggctgcaaattataatgaagagatgcaaaacccaaaagtctgttggatagtgagagatggtaccaataagatagtgagacagggaaaattctctataagccaaattgccatcggcaacagacagtcgttaggctccatagaattcaacttgaaagatatagaaaagcccgctcagttgaccttggaagtattgatagacaattatgcaaacaattggaatttttgggtatatcctacagaaaaggagattgtaaatagtaatgatatcttactgactgattatttggacaagactgccattaaacgtttaaataacggtggtaaggtattattgtcattaaagaaaggtacgttgaaagatgagtacggtggaaatctagccattggtttttccagtatcttttggaatacatcgtggactaatggacaagcacctcatacattaggtattctatgtaatccgaaacatccggcattggctgctttcccaacagagtatcacagcaattaccaatggtgggatgcgatgacccattctgcacccatacgtataaataaggtgtccaaagaagcccagcccattgtgagagtgattgatgactggttctccaatcatccgttggcattgttgtttgaagtgaagataggcaaaggtaaattgttggtgtccggcattgattttcaccgcgacatgcaaatgcgtcctgctgctcgccaactactttccagcttgttaaactatatgcagagcagcgatttctctccgagacatatcgtgaaaattgaaacaattaatgatttgatagataagtaatatgaacaaaaatattggattaggcatacttctcggattaggtatggttgcacttcctgtggaagcgcagaatgtgtatgaactgacagcaccaaaggtggagaagataatttataccaaacatctgaaactgggtggaacggctcctgatggtggaagcatagaagtgaatagtttttatatgttacggaacggaaagcccatgctgcccgttacaggtgagttccactacagccgctatcctgcagaacagtgggaacaggctatcttgaagatgaaggctggtggactgaccatcattcctacttatgtgttctggaatatccacgaggaaaaggagggcgtgttcgattggaacggtaatagagatttgcgtcgctttgtggagctatgtaaaaaacatgacatggacgtgattgtacgtattggtcctttctgtcacggagaaatacgtaatggaggtttaccggattggctttttgcgcgtccagtagaggtacgctccaatgatgtaaactatttgaagtatgtagaacgtctctataatgagattgcagttcagttgaagaaattgtattataaggatggaggtcccatcattggtgtgcagatagagaatgaacaccaacattcggctgcgccatgggccattcaatatcccggtgaacaaagggatatgacggctgccacctacgattcgtccattacaatgattggagtaagtgaacagcatcagaatattacgatgtctgaattgggcgatctacacatgcgtacactaaaacagatggcagagaaagcgggtatcattactcctttgtataccgctaccggttggggaatggctgctgtgataggtaatgaggcactacctgtaactgctgcttacacctatccgttttgggcaaagccctctatgtctcctttctgtctgtttaaagacattcagcgggtaccagattattcgccggtgcgctatgataccgacaagtatccgtcgttctgtgcggagatgggtgtaggtattcagatggtgtatcgcagtcgccctattgtgaaggctgaagcagccgaagcgttgatggtacgtacattgggcagtggtgcaaacggtataggttactacatgtaccacggtggctctaccccgaaacaaaacaatggcgtaggattttttagcgatgacggtatgggtatgcctaagatttcctacgactatcaggctccgattggtgaatttggtttggtacgtgattcgtatcagaatttgcgcattcttcatacattcttaaaagatttcggttctatattggcacccatggaaacggtactgcccgaaggatatgagaaaataacaccggataatcgggaaacgttgcgttatgctgcccgtatgaaagaagatgccggtttcatcttcatgaccaactttcaggatcatgatacagcacgctttgaccagacagatttgcagttaaaactaaagctaaaaaaacagacattgatcattccttctagtaaaacgtttactttgaaaaaagaccaaagtgtgattttaccctttaatctctctatggaaggggcactcttaaagtattctactactcaactcttggctaaagtagaggaaaagaatgccgtacactacttcttttttgctccggaaggactacgtacagaatatagttttgacaaatcaacgttgagctcgggtaaggagttctatacaccgaaacctggtttgaaaagtactttctccattacagttaaaaatggaaagacgttgaagattacaaccttaacacgtcaacaggcattgaacactaccaaagtgaataatcatatccttattactgaagccacagtattgcctgagaaagaacaatgtactttgctaagtttagggaagacccaaatcagctatgccctttatactgctaataaaggatggaaagaggaaaccatagaggtacaaccggtagatgtgaaagctgattggaagaaagtgggtacccgccgaatgaccgtaaagatagatcagcccgatgtgccacaggtaaacgattacttcctacgtgtgaactatgtagcagatgtggcaatggctttcattggtggttatttggtgcttgatcattattactatgggataccatggacaatcggtttgagacgattcaaaaatgaattgaagaatgaatacttgagcttctatttccgtcctttacgtaaagacgcccctttcattggtgatcttcctgtggaagctattccagatttctcacaaaaggatgccgattgcttggtcagaagtgtggatgttatacctgaatataaggctattgttaatatttaaaaatcaaatggcttctgtctaaagcccaaagaaggtgtgtgttgacacaccttcattttctctttaaaatacattccggttcttaatctatcttttcatactactttccctcacctgcaaacaagtaggaataatgatttgcttgatttttttatcccctttaatcttatcaatcagcatctgacatgcagcttcccccatcttgtaagtctgatgcgagacagccgaaagccggggaactacataattggcatgttgttcgtccgtatatccgatcagtgctatatcctggggaatacgaagtccatgatttctgattacttccatagcggcaaacgccaaggtatcattcatggcgagaatggcatcaggaggctcaggaagtgacaataaagtctctgtagctattttcccttcctcgaaatctatcttccggcatactaccaagtccttctcaatagatattttattttccctcaacgcttcaaggtaaccgtgttttctgtttttcactatatccaggtggttggcgccaccgataaaagcaattcgcttgcttccatgatccagcaagtgctgtgtagccatttgggcagaatgtactccatctgccaccaccgtagagaaacgttccggcatacagacacggtcaaacagcacgagtggcatattcatatcatccaaactcagccaatggtcataatccgttgtttcctgagacaaacaccctatcacaccttctacatgcatattgaccagattctcaatatttcttttctcgtgctcgtatgactcatgggaggtcgtgataatgacaaaataaccgtttgctatggctgtatcttctatgccactcaagatagatgcaaagaagtgagtgacaatatcgggcacaatcactccaatggtacgaggggtatttttccgaagactcatggcaaagggattgggatgataattcatctctttcgctaatttctggactttagcacaaagttcccgactgatttcgggactgtttttcaaggcacgagacactgtaggaatagatacacctaatatctgcgccaaatctttcaatgaagtacgtctcgattctgccatataaatactataacggtaattgatttactttacaaagaaagcacattcccgtcaatatccatacaaagatcggctttttttagtggttagtgatgaatcacctgccaagcgacactgcgcagcttattcaccactagccacttatcactaataaatcgcttcccgcatccggtcttcgaatgcagctaaagcagctttggcaccctcacccatggctatgacgatctgcttataggaaacatcggtcacatcgccagcagcatagatacctttcacagaggttcgtccgttcttgtcggtcaggatttcacccatgcggttcgtttccaccagttctttgaacaaagcactattggcagtcagaccaatctggacaaaaataccatccaaagcaaaaatctcttctttttccaatgaacgatctttctttatgagtcccaccactttgtcaccatctcctaatacctctaccgtctgggtattagtgaagatatccacattaggcaggctcctggccttctcttgtaaaacagtatcggctttcaaggcatccatgaactcaaagacggttactttggaacagatacccgccaaatcaatagcggcttccactccggagttcccaccaccgatgactgccacttccttgcctttatagaacggcccgtcacaatgaggacagaaagccactccatgaccaatgtatttttcttcaccgggaacattcaattttctccagttcgcccctgtagcaataatcagtacgggagccttataggtttctccaccttttaccgaaagtactttcatcccttcggccacttccaccttttctatccggcggttttccaaaatatcaatattatattccgccaaatgttttttcaagtcttgagccagctgtttaccggtggtttgaggaatagatatcaagttctcgattcccatggtctcatttacctgtccaccgatacgttcggctatcaccgctactttcaatccttttcgggccgaatagatggcagctgttgttccggaaggaccaccaccggccaccagaacatcatattcttttgtctcagcagcttccaattccacagagccgtaacgggcttccagcttctccaataaatcgccgatgctgccacggcctacatgaatttgttcaccatcagcaaacacagtaggaacggcctgcaccttcatacggttcacttcatcctcattgatagccccatccactgcctcatgacgtatctgatgattcagaaccaccatcacattcagagtctggaccacatcgggacaattggtacaggtcagagacaaataggtggtcagattaatgggcccccgcaatgccttgatacgtctggtaataaactcgtccggaaaattctttcctttgccgtcagcattcagaacagccatcaacaaagaagtaaattcatgaccaccaggtacggcacgaaatgtgattcccgtatcctttccttcttttaaaaggataaacttcagcccttcactatcctgcaaccgacaggaaagtttatccgaacaggaagccacttcttccaacaagtccaccaactcggcacgactttcgtgctgagggtggacaaagatgtcaaaagtatagtgcgcttccaattgggcaaaaagaccttttaactgatcttttatcgcactatctaacatgagttctatactttaaattttacctaccaaatcaatactcggtttcaaggtctcagcacctttcttccatttagcaggacaaacctcaccatcatgagtggctacaaactgggcagcttctaccttacgaagaagttcatcagcattacgcccgatactgttgtcctgaatttcagctaatttgatcttgccttcgggattcactacaaaagtaccacgataagccataccgtcttcttcaatcatcacaccaaatgcacgcgacaaagcacctgtaggatctgccaacatcggataagtgattttgcggatgctttcagacgcatcatgccatgctttatgaacgaaatgtgaatcggtgcttacagaatatacttccactcccattgctttgaactgattatacttttcagcaatatctacaagttcggtagggcatacaaacgtaaagtcagcaggatagaagaagaaaatagcccatttaccttcaatatctttattagttacggttttaaactctccattatggaatgcctgaactttaaattcaggaacttgtgaattaataattggttccatactctttttatttttaaattaaaactgatttttaaattgtaattattacatttgcaaagataaccgacttcagcaccttccacaatacctaattattaggattgtatagaacaagattcaccataaataggtattggataaacgatttttttaatcgaattttgcatggagttaaaaggatgctaaatattttaacaacaatagtttatattagaataattatttaaaagtacatgtagtatgaaaatagaaaaaattatagcccgcgagatattagactcacgtggtaatcccacagtagaagtcgatgttacattagaatcaggaatcacaggtcgtgcatcggttccgtcaggagcatcaaccggagaacacgaagcattagaactacgcgatggtgacaaaactcgctataatggaaaaggaaccttaaaagctgtagccaatgtaaacacaatcattgccccggcgctaattggttgctcagcactggaacaacgtgccattgataaaaaaatgttagcattagatggtactcccactaaatccaaactcggggccaatgccattttaggcgtatcgctagcagtagcaaaagcagccgcaaactatctggatatacctttatatagatacataggtgggacgaatacatacgtaatgccgattccaatgatgaatatcatcaatggcggttcacatagtgatgctcccattgcttttcaagaatttatgattcgtcctgtaggtgctccatctttccacgaaggtttacgcatgggagccgaagtattccatgcgctgaaaaaagtattgcatgaccgcggtctgagcactgccgtaggcgatgaaggtggttttgctcctgccttgaacggaaccgaggatgccattgagtctattctggcagccatcaagaatgcaggttatgaaccgggtaaagatgtcatgattggtatggactgtgcttcttctgaattctataagaatggcgtttatgactatacgatttttgaaggagaaacaggcaaaaaacgtacgactgacgagcaaattaattatctggaagaattgattaataagtatcctatcgattctattgaggacggtatgagtgaaaatgactgggaagggtggaagaagctgaccgaacgtataggcaaccgttgccaactggtaggtgatgacttgttcgtaaccaatgtagaattcctttcaaaaggtattgcacaaggatgcgccaactctatcctgatcaaagtcaatcaaataggttctttaagtgaaacactggatgctattgaaatggctcatcgtcatggatataccactgttacttcccaccgctcaggagaaacggaagacgcaaccattgcagacattgccttagctaccaatagtggacaaatcaaaacaggctcattgagccggagcgaccgcatggcaaaatacaaccagttactccgtattgaagaggaactgggtaatttggccgtatatggttacaaacgaatcaaataattggatcttttgtacatttatgtaatcggatagcgtctttgagaaaaggcgctattttttttggatattgctttccgatgacattcttaaaaaaaatataaaagcctcctgtcttctgtctgtcctttaaaggttttatgtacttttgtaccgctttaaacaaaaaacaatcaataaaaatggacgattcaataccacgaacgtgcaatagtattaactgatccgacagggcaatcactactctgaatgcctctgaacggatataaatgaacgaaaggaggcaataagatgagaaaatatctttattgtgaaaatggctttgtagaaaagccacaatggatgccaaactgctgggtgaatgtagaatgccccgaccaaagtgattttgagtttctgactaaagaattaaaagtccccgaagcttttttagaggacatcgccgatatggatgaacgtccacgaacggatacggaagacaactggctactgaccattatccgaatccccctgcaacaacagggaagcatcccttatatcactatccctatcggtatcattacaaataatgaaatcattgttaccgtgtgttatcactccactgaaatgattcctgatttcattgaccacacccgacgtaaaggaatcattgtgcctaataaatttgaactgattttacggttaatttactcatctgccgtatggttcttgaaatatctgaaacaaataaacaatgatgtagctgccgcagaaaaagaattggaaaggagcatacgtaatgaggacctgctaagattgatgaaactacaaaaaacattggtttatttcaatacgtccattcgtggaaatgaggtgatggtaggtaaattgcaaagtatcttccaggaaaaagattatcaaaaccgcgatttggtagaagatgtagtcattgaattaaaacaagcatataacacggtaaatatctacagtgatatcttaaccggaaccatggacgcatttgcttccatcatatccaataatgtgaacaccatcatgaaacgcatgaccagtatttccatcattctgatggtacccacattaatagctagtttctatggaatgaacgtagatgtacatgtagatgcattaccacatgcttttagttttattattttggcgtccatcacattgtctgcgttggcctttgttattttcaggaagataaagtggttctaaaaaatcctgtaacaatatcatatgacctgtcattcacgacaacaggtcatatgataaaactgataaaactcttttcgccccctaatcttatgacaaagagattcaatttactcttgatttctttctccaaatacgttttatccataaatagtatcctgttaatggcaaggtggctcctatcaaagctgctataaacgtcagtaaacgagtaagcataccgccccaactaccaacatgtacagaatagatccatccgcgaatctttccagccttctcagcatctttatataaaactacctcatcaatctcaccactatgaggattgaatttataacggtcggaagcacgttgattaccaaaggtattgaaagaaacatttgctaccccatctgataaggttatctgtttgtaaccgggattatttagggctaattgttcataaacttgttgccaacaaacataggacgaagaatgagaaacattctttccaggttgatcactacctctaccaccacgcagagtcaccccactatgtgtacctccctgttgtacttccacgccaaacactttatagaaacctgtccgataccatccaaaagaccatgttaacccggtaagggccatagccaataaaaaaaacagcgcatacattccacctgcaacatgcaggtcataccaaaatcttctaaagcccctgccgacagatattcttaaactatttttcaaggcttttcgtgtacgaggccaccagataacgatacccgatatcaaaaccacgacaaacaacagggtgctgacacctacaatcatttttccccaaaagactccgccatccgctttcatactgtccaacagccagcgatgcagcctgaacatagtcacaaaaaatgcaggacgttcatatttacctttaatctcaccagtatattgatccacatacatagaagcacgacgaggcttggacagattcacctgccaagcgcgttccgggtcagaaaaaacactgattcctatcacaaacacactgtcgggtaacgtgagttctacctcttctaataatcgatcaacaggaagtggaactgtctctaccttttttacataatagagttcatgcctagccagttccatcacttcattttcaaaaaccagcatagctcccgagaagcaaatcaaggtaatgattaacccgaaaggaacagaaagccaaagatgtatttggcgaaatattttcttcataaaatcttcaatacaattcataaaaagagtctgcataagcacatactgcccgcagactcccactatattattacaatactcagttctgaggttgcagtttaccgacgccactgatttgtgtcgcttctatagaaacaccctttgtcgctaccgcaccaaccggatctattttataaatagacggatatccttctgttgtagttacagccatataggcatatccattctccacatacggagtattaccaaagccagagatcaaatcggcagaaggcaagccggttacataagtaagttttccggtttctcctttatatatcgctaactgattagctgtgaaaccagtttcagtcaagggacgatcatacatcaacaacaagaaataatctcccgtaatatgccaacaacgaatgaaagatttacctccggtctgcgcttcgatactataataataatcaggatcaaactcttctgttccagcctttatacgtacgactccagcatccaaggtagtctgttgccgtttatcagccattgttttggcataactaggagaaaatacataaatatcaccattatctgccgcccaaatagtttggtaatattgagacttcattcgcccacaagcatagctgattttatcagtctcaataatctttttagtagtcagcgtttcattatcaaaaatagcgacccagcatttgttgggatattgcgtccattgcaattcgccttttttataactgctgctgttggaaccaccgtcttctgtctttaccaaatcatcattgccaggaagtatccattttcccccgtcagtggccgatccatattgacttaaccccattggaatagcagcgctatacagcttattattttgttccaatatgccggccaatgttacatattctccatttcccaagaagttctcggacatataagccttattttgagtatcattcgttgtaaatgtttcagcagatacatccaaataagaaagcaaaaacatttttggtaaatatccattctcatcagcatacgcagtgggtccgtcaccggtagacgaggtcatgatatatttatcataaataccgtaagtagtaaatctctttatggcaaactcccccgaacgagcctttacttcattatttgaatccatgatataagaacgggtcgtacctgcattcccttgattataagtcagtgcataaagatattgattcttgtaaaacacccattgagttgcgccatcattcacaagaccattattcactgtagaaacagtgcctttatccaacgtttcagaagtaagcagtacattcgttgtatttccagacgctgtgaccgaagatgcaataacatactcacctttagcctcggtacccgaaccgtaatccggctcattatccgtacatgcactcaacaccattcctactatggcaatagcaacaaatccattcaaaaagaaaactttcttcattttattcttctatttaatttaaaatccaattaattataaactttttccaattctttaattaccgaaacaaacacgcagtttaccataaaaagcccgaccggccttctgaagactaaaattatcatataacttctcatctgtgaagttacgacattccaatgatacgttatatcgtcctttttgcaaactataagaaagggatatattgtgtgagaattgatcaggtaccacatagtcccccttatttgagcctattcgggaagaataataagtaaagctatgcagatattgattatcataagacactgtcaacatattgcctttccttcctaaatcccgccaataaaaagtaacatccgaatcagcaaacatataaggcaggttcggcatccgttctttataagccaaattttccgcactgctggaaatagatgttttcatattgtcgcgtacatccattttagtaaaattacctcctatactcacccaattgccaaaaccgtaacgagcagaaacagtatatcctttcgtcaatactttaccgtaattaatatatttcgcagcatatttaccaccactcaaatccgcaatattacgctgaatataatctttcgtattccgataaatcactccaccttccatatatacagaatgcctgccaaatgttctgttatagctcaaattaaaattcaaattatcactactctcaggttttatactgatatctcccatttccaaatcctcatctccaaacatttcttcaatagtaggcagacgatatgctttttcgtatgacaattttgcctgcaaaccggatagaatgaaataagttcccgcagctccataccctatggaattcatgtttcgggtagtacggacataatcatcctgattcgtagtcgtagccataggacctgctacatacaaactataatattttccaaacactgagaggttccaattatcagacggcatcaaccgataggataatccggagatattcttatgggtttctttagcgatggcatcctccgattccaccttagccaataaagaagtattagaacggcgaaaagtattcaacacatgattaaaggtcagcatgtgtattttcgccagacggtaattaacagttaatgttccattccaattgttattatccgcccgtgaatattgattggattgttcaccgggtgagttcattaatttcctatcacccaaccaattgtacttatatgaagctgtatctatatttgccgttgcatttttattataattggcagtcaatgccacattcagacctttgattaataagtcacgcttattatactccaatgacggcatcaacgaatgtcctttacgatgtttttccccataaactatttcctgacgtactccggtctgtatctccttatacatatgtgaataagtaaagcccaacatcaatctgtctgcccatttcttatccacaatgccaatcttacctataaccgcctcattatgataggtatcattaaagcgcttgacacgtacccttttatctttatcaattcttccggtttcaaagtcctctaccggtgcatccacatgataatcattatccgaatagttttggaaagcatttatttcataagtaaagccatttttgaaagtttgtccgaaattcacatacgatttatgcgtattgaacgacccgtatgaataggagccatccaaaaaccaattacgtctcttcttattggttacaatattgataacaccacctatagcatccgtgccaaatcctacaggaaccacccctttatacacttcaatcctatctgcaaaattcacaggaatattatttaagccaaaagaactccctactccctcctgaggtacaccgtcaataaatatcttcacatgtttgccactgaaaccatccaacatcaattgcatatccgaacctaccccacctgactcacggagtttcattcccggagctttagccaaagcatcactcagatttttggtagaattctggaactcttttgtatctacagctatcgcattgaatgcggaacgtttcacacgggaaaccccgttagataccactacaacttcatccaattctgtcactgacggggcaatcattacattcatcttaatcctttctccatgaactaaagttatgggcttttctatagtctcatatcctatagccgaaacaaccagtgtatatttccctgccggtgcatgaagatgataaataccttcttcattcgttgtacagccataagttgtacccttcaaatatacggtcgcaaaatctacgacttcctgtttttctttggatatcactttaccggataccattatcttaggttgtgcaaagatagatatcgctccgattattaaaaaaagggatcctaaactaatcctttgtaactgtcttcttaccatgaatgcctataattctaaattcttaatttttgggaatgcaaagttctataaaaagaaagggggaaacaatcacctgatatcggtaatcttttcccccattttacagaatatatatactacgcaatagctctttataggtatttatgcaataaacacgctatcgggtctagttccggaaatcaaaccatagcttcattctaaagccatcatcccctttattaattttaatataagaagcctctcctcctgtcccctgagagttgacagccggaatttcaaataagaacgaaaggtctccagcaggatattcctttactgatattccacggctttcacggtcacgctgctcctccggagtgaagacgcgaaagaaaataccgtcagtttccgaataaactgtcatcggtgttgtctttgattggagtgttgcccaatagagatctgcatgataccctttgaattccggataaataagctgatgataatattctcccgtcaccgtattgttgtagtccttctgccaaataccataattcgttccttcgatacggttcttccatacccggtaaggacctttgcctaaccaacgcatcccactgatgttcttttcaggaaaagagaatgaaaaaccgaaattaagaaccggacggtcaaagtatacaccgtcaaacttgttctttgctctgtaattcagcactaatgcatccattccaagcaatccgtcaggtgccattctccagacaatggagtcggccgcacctttatattttacggtataaatggcagtatcaccttgcatctttaggttagcagaacagaaaagcatcttcatcccgaccgggagaggaccatcagacaatggtatgatcttgctaccgttcttcacttctaccaaattaccattcgctttgttgaatgttgctgtaactccattcgctatcagtgtaacactattgtcgtctgtctgatatctggcagtagcagttgttgtcggttgtaaatacctgtattctataaagtacttacggttattcttgataggaaacgtccaattacatatcatatctcccgctacattgtaggcttccaattccaagatgtctccattgaagaatttctcaggcaaatcaaagtgggctatccccttctcgccaggctgaatcgcaggtaacagtacgccgccctccgctaagcagatggggctgtcggacacctgtggaataggtaaacgcattaccttccacttcatccggcattcgcttaagttgctgaataagtaatcgttagttacataaaaatctcctttgaaagaagaagttatttttaatggatgtatttgaatgggtgaccatacctcccgaacagtataaaaactgccttctttttcgcgatttgcccccacaataccatcgggagcattaggaccgtaagtgtccatttgtccggtatctgtacggcggacagcttcatccacatatgcccaaaggaagccaccggcaaaaagtggatttgccttaaactttgaccatagtcctttgaggcctgcaccctgtccacggtcatagaggccatgcaggaactccgtcatcataaaaaccttatgcccgcgttccaaccgatacatgttatccgtaccattagggtaatgacgtgtatccaagccattgaaatccgcccacggatgaatgacgtgacgtttctgcggatcatagtcggcaaaacgattgtcaacagcagtattccatcctccttcgttaccatttgcccaaacaaagatacacgggtgattcacatcacgaaatatcatctcaggcagtaacttttctgctatttcagtgctatagctattctgccaaccacataattcattgagataaagaagacctatggaatcacacgcctctaaaaaatgagtatctggtggataatgtgaacgcacggcattcatattcatctgcttaatgagcaaagcatccttcagactgagttcccggctgattgtcctacctgtttccggatcaaagcaatgacggttaatccccttcactaaaagacgagtaccgttcagatatacgccatcttcaggacggaattcaatggtacggaatcctatgcgctccgtaatctcgtgcacaacatctcctgttgtggaaagaagacgcatcgtgagtcggtaaaggttgggatgttcaggatcccatgtcctgatattgttccaatgtgtggtaagtatctgtttctcttccgtcgaaagcccgcatacctgccgccctataggaagctgtgaatcacaggaaatgagcgacagttccaattgttgtcctttggaaatatttttcaaatatacatctgtgtgcaacgtaccgtcagcacgggcatccaccgctatatgttctatttgcgtgcgaggctttgccgtcagatatacaggacgatagatacctccgaaaagccaccagtcagcccggcgctccgctgcattaactgatttatcagccgactgcttcttcaccgtcacttccatcaaattcgttttcccgaatttcagtctgtccgtgatatcataagaaaaacgatagaatgatccctgatgaacagggccagcgatgacatcgttgattttcacttcagcatcagtcataacaccttcaaatacaatacttatctgtttgcctttccaagtgtccggaacatcaaaacaatgacgatagatgccgtattcatcgcaaaaatcatgttccctgtaggcatcatattgcttttctttctcgtgttccttataaatataatagcgcccgtaggtatagcctccaaaaccttgctgttcccagcaagacggaacatctatcttgctccacttttgagagttcatacctgaagagcaccagaaattccacttcacagtatgatccggtcctgtaccggaaagatacctcacttctgtctgttgagcttttgtcgtgcaaaagcataataaaataatgaacagtccaataattttcttcatacaattcatgctacattaataggttggttgaactggaaatacatagaacattctgtctggtttgaaatcaatcatccattgatctatcaggacatgatcatccaaagcagtgatggataaagtatgctttcctttcgtcaattgatgaccagtttcacgaacagcctgtccacggagtacattctgtttccatccttccgaacgaaacggctctttaatagaacatatccgaggcttttcaccatctatactaacactgaaacgaatatctcctttatcattaggttgtgtcgggattacggcagtgcgcagtatcgcctctccatcccataaacaatcaaactcaaaagtaattgactttccctttggtacggaaacagcattcatactatgtcccaatgattgaatcgtcacgacccctttggatgcgcttgtataatcgcaagcattagaaacaatacaatgatccttagccacttcctccaaaggtaacgattttggtcttctaaaagaagcatatttctctatttccttatctgtcagccatatgggaattttaggcggatagaacacatataaatcccgcggattatggcacatggagtatttccatttgccatctgccagttcattgttatagtaatctgtcaaatcgcggatttcctggtaagctttaatgcttttggcacaggcagccattaattgactttcgcgggtccataaagtcgtgtcgcagcttcccggagagatgcaacgtgctctttgtgcctccagcatctttgtgctcatggcagcagcgccaaatacaggatacttaatttgggcaaagaaagcatctttgcgttcctgaggaatcattggttccacttccgataaaatctctttaatggcttcataggattccagataacgatccagttcgccgccgaattcggttaagctaaagtccgtatttttaaccggagaccagcctttggtatattttttcttgtccagctccacttggttccaacccataaattccggtttacggatgccgcacaggcgataaaactctaacatggcaggcaataatttttctcctgcttctttgccaaattcgcggcaaagccagctcttctgatgctccacaagagtagatggagatacggaattgatattccatgccatatccagaaagagttccaaatcgtatgccgcgggtttcaaatcgtgcacattaaccacccacaaacggcgggcattgcaatcgtatgcctgtttcatttcactataaatcaatcccggctgggtagtgcataaccacatatagtcatgcggacgcccccaataactgagatgataatacactccggcacctccgttacgcttttgctgttccttgtcacttaaacgggtcatatagccatagttgtcatcacaccatatcaaagtgatgtcttccggcagttgcaagccattctccattatttgaagcacttctttataggggacaaaagcctggggaattttctccacatctttatctacatacttcgataataacttgcgctggtcgtcaataacctgttgcagtgcatcggtcttttcctgaagggtcttgaccccttccattccactgtcgtgaatacctctcatacccatggtgtagaaattttcataaggtccagcctctttcagccgttctatccaataggattgtaccccttcacggtttgttatgtaattatagtcaccccgttcattgactttccattcacctacattattgcgcatcattggctcgcaatgcgaagtaccgatgagaatgccgcaactgtcagctgcttctttagctcccggcacaaagtagaacggagtcgtaattccatgcattcccggccaaatagcattggcacgaaggcgcatcagcaatttgaagatttctttataagtacgtgcaccaatacgtccttttatatcagacggttcaaagtttttccagctccaaggctgcaagctccagtcttcatcatttaaaaagattccacgatactctaccgatggactctgaaaagtagaataatcagccggaagggtcaatcgctcttttctcatcggtgttacatctccccaccatacccatggagacactcctgccaagcgggaaagttcaagtatgccgtaagcagttccccgaccgtcacttcctacaaccaacaactgattttctcttatctttataaaaaaagcgtcttttctggcaacaatactatccaccgggattccgtctttacggagatctcttaggatagacttgtttttatccaactgaataatattaataaccgccgttccgaaaagagttttttgaggtaatacccccgtcacctgttgcatgtcacccttaaacatatccagtgctaccgtcactactggagaaacagatccaggcaaggaataagtaataggacgtttaccattataccaaacaaattctttattggcaacaacctctcttgtactagctgcacaaatcactacaatatgcacaaacaaagctacactggttatagccataatcaataatcgactttccctttttaatttcacattcatcagttattctactttaattgatttttttaataacgaggatgccatatatcataacatccccgtcctaaacacatctcaatactatctaatcaccttactaataccctggattctgatcttcagcactcatcaactcattcgcatcaatcgccgcctgaggaataggacgaagtaatttctttccaatcatttgtgcggcccgcccttttatctgaggattatataaatcattatactccaccaatttctgtgtacgtcttaaatcaatccatcgagatccctgtccaaataactcacaagcacgttcttttaaaataacatccacatttatttcagttaccgcatcaagccgtgcacgtcggcgcacttcattcaaacgaagcaaagcatttcccttatcaccagcttttaaataagcctctgctgctaccaaataaatctcaggaagcgtaataatatgtacatcacgataatctgttttattagaataactagcagtattagaatcatcaaatttacgacaaggagcgcccccataagaataggttacgaattcctcataatcaatttctccaggcatatattcttgaggatcccgtgtatgatcagacatcggtagtatccatgtatttttacgattttcaggatcaagagctttccatgcatcgatatcttcttctgtttcataccatgccggatagtaacgtttcaaaggaattcctataaaagttccaccattcttataccaatcccaataccaataagcggatgcagtaacaatatcaggtaactccttcataaacgttaccccatagcgtatatcgcctttttcaaaacactgcaaagcatgtaaagtcgcaataaaagcagaagtactcccctttccatgatcttcttgcccccccatatgattacaataaaaggaactccacggatgcccaccactgactgtattagcagccgtagcatagtcatattccacatcccaaataaattcttcgttatcatctccactacaatccgctctccaaagatcctcgaaaggagtaaccaaagcacgattagctatcacgtcatctgctacttgggctgctttggcaaagtaatcttttttatctaaatcccaagctgctgctaaataagttttagctaataacgcacgagccgattcaatacttatacgaccaccaccatccaaagcggtagacttttccatagctccggcagctattacattctccaattcctcaataatataagtgtaaacatcaaccaccgaagatttaggatatccggtttgaacatcagccacataatctttcatcaaaggtacccccccgaaagtatttaccaatatatagtaataattcgccgccaatactcgtgcctcatccacacgcctgctacgcaaattctcatcaataactgcatccgccgcataatgttttatagcataagccgcacggatacctttataacatgccgtataaagctctttcatcacactgttttcaggatttaaagtttcatattcatgcaactcatcattgatataattacgcccatcagcatacatatccgtacctgcattaaaataagtagtataactggatactgcataaacatctcgtaaagtactataagcatttgataccaaagattcaaaacctgtcttagtcgagaaatattctttgtccgttacatttgacttattatctgtagtcagaaaatcttcacaacttgtagtcaaaacaaagccaaccaatatgactgccgtatatatatattttttcataccatttacctttcctttgaaattaaaacttaatattcgcacctatctgataagttaccgatgcaggaccaccatcagttaatttagcatttgcccattcaggatcaaatccatcataatccgtaaaacaaaatggattaagcacattgatataaagacgcaaatgctgtaatcctgctttagtaatccacttcttagggaaagtatatcccaaacagatattttttacctttacaaaagaagtcttctgatactgaaagccttctcccttcgcgctacctttatcagaaaaatatccacctgccgaagtatcggaattattcggataaggatattcaccgtaatgagtttcagtggcatatacaatatcaccggtagtatggtcaataacaggcgcccctttaggaatataaaaatccattgccatatgttggttaccacgatcagaccatttcatatatttatcatggaaataactacgagcccattgtccttgtttagtataaatcattactgagaaatcgaaacctttataatacatatttgaacttaaacttcccacccatttaggatctgtacaaccatatatttgcttatcttcatccgtaatcttgccatcattattccaatcattcacagctatctgaccttcataccacttatatttcgaaccatactttgcatacaattcttgcaaagtataatgaatatccccatctttagtgtgcatcgttacccctttatcagttatcacatcagtatgaatatagtcacgcaatacatttaacggctcaccaataaagcgattggatgcaatttcatccactttcccattactaagttccaatattttattccagttacgagaataattcacacttaaatcccatataaaatctttactccgaataatgccaaactgcattcctaattcaattccggtattacgaactgaaccgacattaaaagtagcttttgtttcacctgtttcaacaggaacaatcctatccataatctgcccatcagacaaacgatgataaaaatcggctgtcagattaatacgattactcaatgcactaaaatccaatcctaaatcaaactcttttaccttttcccaaatgagtcccgtattaacaagcccattagggtaatatccttgtatttccgatcctcccaataccacataactaggtcctgaagctgtagctattgtcacataatcatccacattgttgttaccggtaactccataagacaaacgcaatttcaaattatccaaccaatgagtaccttttaaaaaactttcttctgacatacgccatgccaaagcaacggaaggaaaccatccccaacggttaccttctgcaaagcgtgaagaaccatcagcacgtgctgtagctgtcgccatatacttacctttatatgaataattcaaacgaagagctcctgagaccaaagtagatgctgtataggaagaagctatctccttatcaccggaagccttatccaaggcatgaaaagaaagcatatcatccgaaataccaaagcctttcaatctataaatttctttatcagaacgatatatggagaataaacccatcgcgccaaacgtatgatcacctattgttttattaaaatcaagctgattatcccaagtccagtccatacggtctgtcgtctcaacctctgcagagttcgttccgttcacctgataataattggaacctagcggattacggtcattcactccagtagcattaaactttccttgacgcccatgataaaagttaggtgaaaaagtagtcgcaaattttaatccatccattatattagtacgcaaatatacattgccaaagacatgaaatttgcgagtttgattagtatagttttcatcctctaaatcattcagtgggctaacagtagaagtgaattgtccggtagacccaaaagcatcctttgaccctggattattgataatgttaccattttcatcataaggtgcaacaaaaggattgaaataaaaagcgttttcatacggacaataagttccatcggtactaaaatcatcttgcaccgtataagccatattcacagataatccagcttcaaatactttggaaatttttccatcaaaagcacctttgatattgaaacgggaataatcattatgtttgaacacattttcttccccttgataaccaactcctaaccgataattaattttttctgtggctccgttggcactgatataatgattctgctgattacctgtccgagttacgaggtctgtccagtcataaccatctgttcccgacatcatcatctcataaatttgggaatcacggtagtttgtaccaccatcacgtttcagaaacgtagtttccaaatcagattgtttaatttcataatgaggaataccgttcgcatctactcctttacgactagaaccatcaaagacatctgatgttaaaagagtatgacgtgcaaaacgataatctataaattcttgagcattcataaaatcaggcatacgggcaaccttacgtatcccataatatccatcatacgaaatagaaacatgttgaggttttcctgcccccttcgcacctttggttgtaatcataatcacaccagcagaagcacgtgagccatagatagcagtagacgaggcatctttcaagacgtctacccgctcaatatcctcgggattcaaaaaatccatagacgagcacacaataccatcaattacataaagaggagcagcctgtttatttatagatgcctgtccacgtatctgaatattaaatccgccacccgcacggctattggattgagtgatatttactcccggaaccgcaccttgtaatgcatcttccaaacgggtagtacctctagcagcgagtttttcagaagatatagaacctacagaacctgtcaaatctgatttcttcatggtaccataacctaccaccactacttcatccaatacttcggtatcatccattaaagtcagactgaaagaagtctgccctttaactgggatttccaaagtcttgtatccaacaaaacttacctgaatcgtcccattggtagggacatcagaaagaataaagttcccatcaatatctgttatagtcccattagcggttcctttcaccaccacactggcaccaataacaacctcaccatttgcatctattacggttcctttaatcttactaggctgctggtacgcagaaaccaataacgattcatttaccgcataagcaacatgacttcctgaaagaaaagctgcacaaataaaaaccgcaagaagcgattttctgtttccataaaaattagatttcattagccaacctttttaaattagacattaaagttttaatgccacaaaagtaatcagctattcattttacagagatgaagcatctcccgataaggttgaagcatgttttctccaccttttaggaacatatttcaaccttgtccaccttggcatgttcaagcgtttttgcccgatttcatcgaatattctgtaggctgcataccaaattccttcttaaaacagatagaaaaatacttgggatcattaaacccgaccttataagccagttcggaaatgcggaaattcggattttcatccatcatcctgcaagccgccttcagacggatactacgtacaaagccagttgtattcaatcccgtcaaagatttcaatttcttatgcaacgttgtacgactggttgccatctcatctacaaactgcggaacatcaaaatcgggatcatccaaatgacggttcacacaggcgacagcatcctgcaaaaacttttcttcatccgaaggtatgttcgtaaagaactgcaattttagatgatgcaccttgtccgtctcaccttcctgcaaaaacctacgattacgcaataacagcctccgacgaatctcccaccatatcaataccataaacagtatagccaataatacataaataaaataagcccaccaagtagcccagaaaggtggttcaataataatttccatttctctcacgtcaccccaatcaccattctcattcgttgcccgtagctgaaacacgtactcccctgcaggcaatttggaataataggcagtccggctggaagcgtccacataatgccaatcagcatcaaagccttgcaacctgtacgcatatttattttgctggggacgattataagtcagcgatgcaaaacaaatggtaaaatgggaatatgaggcaggaataactaatctgtctgtaaaatcggaagtaaaaggagttatctcctttcttttcttatccgacatctgttccaatggtcttccatccaccaagatatcagttatgcataaagaaatatcagcatgtttctcttccaccacttccgagttgaaagtcacaattcccctgctgcatccaaaatagaaggtaccatcacgatagaaagaagcattttgattaaagaaattatccgccaacccatcggcaactgtaaagatacgtaccctgcccttttcctttccggatatggttagctttgccagcccttgattggtgcccaaccacagattaccactattatcttcctgcatactgccaaccatatctccgggcaaattaaactccttatgaacagacttgaaacaatcattttgcacatcatataaacaaagtccgctgccctctgtcccgacccaaatccgtccgcttctatccaacaaaaaacaaagaggagtattaaccgacagcaaaccattctccatacaatagttcttacactgcaacgattccggacgttccatatcccctgtaacatgaacaataccattattgttggttgccaaccataatgagccgtcattatcctcaaccatcgtggtcatctcccggccaagcaattcgtctgctctggacaaacgattgaaacaatactcacgcccgtcccggtaacgcactccaagtcctttataggtacacaaccagcggtttcccttacggtcctcgtgaactaaatacactaaatcatgaggaacaaaaccgcaattcgaggtcttatactgatgtattatttgtccatcacgacaaactatcatcccctcgtcatgcacagcaagcaacacctcacgggttaacgggctataagaaatatgataaggacgtttcgaaggaaacaatgtcactttttcatctccatgctgataatccaatccatagcccatacctatccaaagagctccattttcttccacatacaatgtagaaatcaaatctgtaaaagatttatcgttgccacgaggataaattacattaaaggaacgtttcctagtatcgacatgaaagacaccagcccctttagtaccgatccacattaatccgcttcgatccctaaagactgtgttcacctcgcggacaggaagataatgtgtagagccagattcttgataattgataaactttccctcatcagccagttccatcacactaacaccctctctagtacccaaccataacgaacgtgtctgtaaatcttcatgaatcgaataaatataatcagacggcaaagaagaaacatttcgggcatcatgtctataaccttcaaaagaaaccgttttcctatcggatgaaaaatgggccttatacagcccggacccactagttcctatccacatcacccctctagagtcctgaaacaaagccaaaacagagttctcttcatctaaaggcggatagtgcaaaaatatattttcctttatgcaataacgataaagcccatccttccaggtacctatcaacaaatcaccatttacatcctcaaacaaagtttgaatattcacagattcgggtacgtcccctctacaattcttccgagtcatcaaagccaatgtatcctgcatttcatcataataagccattccacggatgtaccccagataaacccggttctcttttgttacatgaatttcattcagccgttgtttgctgactccatccagttgcaattttttcatcttccctgtccgtttatcaagcatacagagtccctcgtgagtcccaatccaaagccggtgagaataatcttcttccacacaaagcacattattattaaccagaagaccaggggtataaagatttgatttataggtacgtacctcgtaaccatcataacgaaacaatccatagaaagtaggaatccaaatatatccgtcacggtcctgatacacttggtgaaccatgctattcggtaatccttcaggagtggaaaactgtttgaactctagatcgtcccaacagacatgagctctcccctgaaatattaatccactcattatcagaatcatgaatactagtctaaatgttttcattctattttctattagatttcatttagcaaacttacaaaaacctaagaattaaataaagttttcagaataaagaatcatgtataaccctatactatgagattactcctaatatataatttcccaagaaccaccaatagaactcagataaaaaggcagtcggttcagtatgaaccaactgcctttacaaactttaaaaccatctctgtcttataaacagaaatagtatgaaaaaggaagacttatcttcacccagtaaaaatagataaagaatagaaaacaaattaaaaaatagatttcaaaagccttccatcttttcctccaattcctcctccgtatccacaatacccaataagcagtttatttcccttcttttatccaaatctttaaaataggtttccaccactttataaagatcaaaatgacaagttgatccggcagccatatccaatgagtccacgatcctttccactgcctgatgaattttatccacatcaatcaaatgcagttcattgctatgaataaaatatttttccataatcattattttttctgtttgtactatcattagaacagtcgaactatggagaatgttttaaaaacgaaagctgctcttatttacatgtcttgaaccgaaatggcagacacaatccttacatcaaaaatccccccagctatacaaccattctttgcctgaaatttcactgttacattttttcttgcttttatatattcagcaggaatatgaatataacatctatacagtccttttccttctttacaaggtttagacaaatcaatagtatctatccatttaccatcaatcaaaacatcaaaaatacgattacccgaatcacttcccaaaagctgtaagcaaacagactgttccgtctctttccgaactttcatttcatacataaaatatccacctttagaagcatcccgccaattctcaccagctgtagaatttactgcctccattttatgcattttctcagattcagcatctgcaataatgaccctgtctacagttcttttattcaagttatcctcttcttgcttaaattgctccgatttcttcagctcggccaaatagttctctttcttatcataatgccgaaaatatacggcatagcggctccagtgaatagtattaaaaggaaccagctctacaggcttggatactacattatccttactacacaaaaaagccagcttctctccttttttccggataacagcagccggtattttccggatatcccctataaaagccggcacatctatcactggataatctttcatagcaacagtagaacgtgcagatctgaaatcatctttcgataaatgctcgtcactaattctagctgccaaaacaataggcccatatttcaaagcaagataatgagtcgcctcattcaaaggcactatttccaatttcataggtagctctatccgtactttatctccatctttccactgcctgtttattgaaacatatccatccacaccagcctttattttctctctcttaccatttacaattacattgagtgacgaacttcccacccaataaggacaacgtatctttaaattaaaaacagcctctccggaaacagtaagactagtaacaccttcatcaggaaaagcagtttcctgatgaatactgattcctttatcccatgtaactaccgatggtataaacatatttacatacaaggcatcatctgtatgagcataaatcatttgcccaaactttgctgtttgctcaaaccccgtcccggtacaacaccaaaaagaatcatatttagttccataaattttatagtgtcccggtttcatggaagtataatacacacacataccctgatcaggatcatagttggccaaaatatgattaaataagactttctcataataatccactttctccacctcggcataatcacaatataaactctctgtcagacgaagcatattaaccgaattacaagattcaggtcccccgttcaattctattcgatgctcgaattcctcaggagcaaagaaatgttctcctgtactgttacctcccatcacccaagtatgttttctcactactgtatcccaaaagaaacgggcagctgtggtaaaacgttcattactatcataacgataaacagattcgaaacctgtaaatttaggaatctgggtattagcatgccaaccctccaatatatcctttccttcagacatgggaacccacatatcctcatcgttgagtctttgtgcccacttaagatacttctcctcacccgttatctgataaacatctataaaagactcattgatagagccatgctcgcacaccaacaatttttgaagatcatcatgtgataacttgtcaataactgaatagccgaaccagtctgccatctttaccaatatttcttttgcctgtaataaatcacatcgcatataaacctgataaagccccaacatgatcttgttcatgacatacacaggttcccagcatttgtcataaggagtctcaataaaaggattagaagtcttgaaatttccatccagcacattctcgaaaatagctctaccgcaaatagtaggtaacaaatatccatcacctccagcttgctggcaaagagataactcctccaagatatagcttaatctacttagaattgcagtatctcccgtagaatcatacatcatagaaattccagacagataaaaccccataatatgtcccggtaaaggtccatgcccgttcatatactcagattcccaaaaaggatagggttgtgccttaggtgtcaaacctgcttctctccgaaaccaagacagcaaacggtcaggttccaaagaaagcatataggcgtggttcaggtccatgatatgtttaaaatcactatccagtaaacggacttcttttaaagagaacaaagaaattttatctccattcaccggctccacctttaccttgttttcttgtgcgtatacaccggaaaagaccaataaggtatatagaaaaagaaatattttcttcatatttaatgtgctttttgatttatataatgagcgataaaaggatgtctattcttccatttgacctccatattcgaaagaaaccaagttttaccaaagtcatcattcccttgataaaataaatatgtttttcctttccttgttttaaagagatgaggatgtccggactcacagcaattccatgttccaggatcaccattcatcagaaagggtttattagaaagttttgtccaatgaataccatcactacttttagcaactccaatctgctgaggacgattattataggccccggcataaaacataaacatctcatctcccatctgcacaacagatgctccttcgacacacttctcttcccaaggatattcgggaacaagcaccggatgattcaccggactcttccatgcctgtttcgaaaaatccgtatgtgcaggtgccattgcaactcctataatttgggtagaataatcaggagtacgagttgcataatataaataataccgatcctttaaaaaaacgacctccgcatcgatggcacgcccgcagttccactccccttccggagaaaaaataggatttgtagcattacgtacaaaatggatcccatcttcagaccatgcatgacaaatagcatctttagcaccattaccatacgtctgatagaatagatgaaccgtatcatttcttaccaaagcacccggagcacataaccctttagactcataagctgtttgaggtatgatttctccaatacgatgccaatctttcagattcttgctcccggcaatgcctattccccaaccttgcgcttccgcgtttccattctgctttggaggaatagaataatacatcagatatttaccttggaactccactacatgaggatctttagaaaaaggtattccaatacggcttgtatctccatacatcatttgtttttgggctaaagaacaaaacacgcatatacacatcaatccggtggtcataatatagcgtttcataggcctattttttttgcttctgcattctgcaaccaaacacacctccagcaatcataccgggcaaagcctgtatcttaacagttacatgacttttcccccgagttaaatcaacaggaataggatacactttatcaatccatgcactaaaagtttccacccgtaatttttgctctcctatcttttcatgttcggcaaatatctcgaattcacgatttcctccatctgtactgctataagtcaaaaccaattccatcggttgaaccggatctactctcagggtatacgaaaaccatccaccatccgaggcatcacgccatgtatttggtcctcccgtatgagtattctcacctttcaactgatgcgcagtttccgaactttctttaccgataaaaactttatccgtaatacgggcacgttcttttagctgatctttcaatatattctcatcggaaggaagccacacagccatttcaccatttcctctatgagaccgtgcataataaggaataagcaggatagaatctgtcacagactttatttccttaaaatcattctcggcaataatgcgttctgtggttcctttcaatatctccacacctcccaacatagaagcaggagcagcctcaaaagccgtttccggtttcagcacataattcaatacagtccctccattgtcagcaaactctgcacaataaactatcgggccacgctctacggcaagatgattcacatccgcagcaaccttatcatttgctgaaaccttgtggacatccatcggaagacttagttcaattgtatccccccgtttccaactaccggataaaacggcatatcctttctccattacaaaatcccggggttttccattgattgtaatttttacggctcttttatcatgcctggtataagtataaagatcggaaggtacaggctgactatttacccatcccggaatacgcaacataacagcaaaatcttccggggtttccggagtcaatatcaactttatctttccattccacggataatccgtctgttgttccacctgtacatgctttccattctttagaactacatcagcatgattggcaccatacagattcacataaaatcctttggaagaagtggcatacacataccctggcaccgaaggaataaaacgagctagattagaagggcagcaagaacaatcaaaccattcgctacgctctgagccattttcatcgcaagagaggacatttggataaaaaaacttctttccatccaaactgatgccactcaacaccccgttatacaaagaacgttccagcacatcaatgtatttggcatcaccatgcagcatgaacatgcgtaaattccacatgcaattggcaatagaagcacatgtttcacaataagctgtactattaggcaactcatagtttttaccaaacgcttctccatgacgagttgaaccaatagctccggtaatatacatcttcttccctactacattgtcccataatttacccacagcattttcaaaatgccgctcgtttttcaaagcggctatatctgtcatagcagcatacatgtaggtagcccgcactgcatggcctacagcctcatcctgagcaatgactggcttatgatcctgccaataagatccgttacggaactgatcctcactattccgatcatatttgtcatactttccacgagcctccaaaaagaattgtgacaaatccaaataacgtttatctcctgtcaccctataaagctttaccagcccaatctccacttcctgatgccctggcgctacagtaatcttttcttcttcaggaccaaaggtattacacaacaaattcgcactcttaatggctatatcaagaaatgaacgttttccggtagctagataatgagctacagccgcctcatacatgtgtcctacattatacaattcatggctgttgtcacgttcattttcccatcttttactgccagcccacggatgttgcgaatccccgccaatagtacgggtagtataaagataaccatccggttcctgcgcagctcctatcagatgaatcagactgtccatatacatatccagcgctttatcctccttcaccgccaacaagtaagcagctccttccattatcttatacacatccgaatcatcaaacggataaggggaattgaactttccttccatcagtttccccgctactgcaaaattatctatacgatgagtttcctcacatttatgaaaagcaaaaggcacggtaacactacgaatggtttcaatacgagatgcccagaaattatcagaaaagtgtacattggtaaaaggtacatccttgtattgataatcagatttattgctatccgtcgacttacacgcggcaagaaccccggcgacgaataatataaccaacgtttttttcatggtaatctatatttaaagtttatctataattcgtatctgaagtaattttcaattcatacaatcctccggcattcttcccttgagcagcacggaaagtaacattcactttatcctttccacgagtccagtctgcaggaatagaatacacatcgtccacataggtcagatatagttttcgattcaaactgacagtacgtagatagttgccgtcaatcaatatatcaaactgacaagtatcaggcttgtctccccagaaacgacaaatcagatgataaggcttttgttccgttttatttatatgaagtgtgtaagaaaaccatccgtcttttgccatacggaaccgagtattctttgcccaaaaataatcatgccaataaatagaatcattctctccttgcaacgcatgtttcctttcatctttcccgtcaccgatcttcacttcatccgttaaagaacgagtacgataaacaaattcatccggagaataaagtttccaatatacagtatgccgctgatgatgcatttgaaaataagggatcaaccctaccccttgttgtccacctccattctttactgtaaaccgtaaaggatgttgtgaagaacattgtatccagctatccagatcggccaatggacccactaacataggaatattctttgccggaagcgattcacgacaagcacgattgtcaataaccctatcttcgggcatatcatccgtccccaatcctcccgcaagcaatatcgggccatacatgacagagccgaaatgaggttcatcctttgcataatcaatatataagttacgtgtgaaaaccaatgttatcacatctccgctcttaacagaatccaacaggcgaatgtagcttcccttatgtgcttccgtctgtgccggctttccattaatacgaactacagcatcaccgctcacccaatccggataacggaacagaagcattcctgtatagctccctatttcatccatccttactgtaaccgtatccgactccgggaaataagtatccaaagtcagcttcaaacctttttccttccagtggagacgtgaaggaatatacagattgaccagcaattcttggttatccttaaaataaatggattcggcatacttagaatgattctccatccctgtacccacacaacaccagaaagaatcaaacggagtactatattgcttaaatgatcccggcaacaaagaagtataataagtcacacagcccggcatatcaggatcttgtgaagcaagaatatggttatataaagcatgttcatagtaattcagatatttataatcaccatccaacatgaacaactgtcttgacaatttcaacatgttatatgtattacaagtttctgccgaagtatagtccagccgcttgctttcttcacccggtacgccaaaacgctcataacaactatttccaccgatggccaatgtgtgatctttaattacaatattccaaaagttacgggcagcctgataataaatatcattgggtgagaactcatactctctggctactcccataaatttaggtatttgatcgttagcatggcgaccgaataacacatcttctccgttagcaatcggataaataacattgatatgattgaacctttctgccgtctgcaaaaatttcttatctccggtaataccataaatatcaacaaaaacttcattcatccccccctgttccacactcaaggtactttgaaaaagatccctattgctattcaaggctatatgagaaataaaattcgccaaaggcatcaatatatccttggcttgcctacaacctgcatagacatatgcatccctcaatcccgccaaaatcttatggatacaataccatgagttcccattctggttataattccaaggttgtccggtttcatccggctggttaagcaccacattcccttgaagcaactgcaaataaccctccttccctcttttaccggtaatgaaccaaccatccggggtctgtttttggcactcttgcagttcatccagcatataattcaatttatccagcaaagctttctcgcctgtagaagcatacatcatggcacaagcagacatataatgaccataggtacatccaccatgcttctcccatcctccgtaattatctcctttcccctgcaaaccgacactacggcgtacgtgtggaatgagcctgtctacatccagcgacagcagatatcctttatgtaaatccatcgctttcttaaaatagctatcggttaattcgacttccgacagtgcaaatgactgccataccggaacatgtacacgaggtgctttgcgcacctgctcatattccgatgcagtcaacttgatcactcctaaaaacaatatacttaaaacgaatactaacctatattttttcatggtaacagattttataaaaaacacaatcaatgaatcaattcaatcttacggaaatcagcaaaggttccgtctccccctttagcacacaagcctatgcggaagcccattccccacggaacatacggcgaagcatcaatttccgttgccaaaggtatccacctctgccctttccggaactcaaagcaaagccaatacccgtctttcacagtcatcctgacctgtgccgttgctgacaccgttatagcactttgagccaagacatcaactttaccatctacatttttccatacttccaccttatctttcaaaactgatatgccaataccggctaaaggagcgccaaatccattatgagctccaccaataataccgataccagccgcagccatacttttccggttatcaacagtagcaatcaacgaaaaattcaaagccttgacaggttgtaccagcagagtacccaattccctgttttccatagatgctcctagatgtaatccattttttcctgtctgataatctattttctgggttaccctccattgccaaatgggagctagtgtattacccttaaaggaatccacataatccaaagacaaattaggacgattataaacggcatcgttcctaaaataaggccagccatcctctccccaacacaattcctccaacacgccctgacgtccgacatataccgaaccactcctattataagcatgatacaaataaaactcctttccatctttccgaactatagtaccatgtccgggacaacgccaatcctgattgtctaccaaaatgggattcttttcatatttctcccatttgcccagcaaagatttggaacgggccactcctgttttataattacatttcttgtcacaacagctagctgccgaatacaagatataaaaataatcctgctttttaaaaacacataccccttctaccagcccttcctcccaaggagtgtcattacagaacaaggaagtcatttctcctatcagacgggtgcggtcctccgtcatctcctgtgcccaaatatttgtaggcaagcccatactgttgccgtcttctttccatataagataaagtttacccttctcatctcttgcagcaaaagcatcaatagagcctggttcctgagcaaccaacggtcccaaatctttgaacctccccatcggggaatcagctaccgccgccgcacacgataatctctttgtcctcttgtcacgggctgtataatacagataaacctttccctgtttctcatcatacgataattccggggcccaaaaattatttaatgcccaatcaggtgctccatccggaaaaacataattcaccaattcccagttcactaaatcttttgatttaaaaatagggaacaacggcgaccattcattagaagtcgcagcagcccaatactctccatttatttcaatgacagtaggatcaggacgatcacccggcaataccggattaataattttttcgtatccaacggcttgcacatgtacaccgcaacatcccataattgtcaatagaatcacaaataacagtcttttcatagtaatataaaattattcataagttacaggaaatgccgagatacgcaaacgggcagctcccatcggtatcaaggttatatcttccaatatttcacttttcggagccccttcttccggcaacacaccacataagccatattgatctataccccaagaaggcactcttctcccttgtgcttttatcactagaggaacgttatcagcagtaaaaggataattgtctgaaggccattctctcttctcgactttcaagcattgctccaaaaccctatcatccaatttcaaagcatagttccaagcactttgaggatagatttcataagtaggccaagcattgacaaagacatataatttattcttacgtattgaaaataaatagtttacaagatttatttaaataaatcttgtaaactatttattttcaatacgtaagaataaattatatgtctttgtcaatggaaggtgatgtgcttcttgataccggaagcttctatccagactttcaacgggcgagaaatccaagaggcatcagtcaatccttcaaaaacaagtgcttcatcatcgtctggacgtatgccgcatagttgaagtgcttgttgaatgacaggcttgtaatcgggcctttttgtcttttgctgaattacgactgcctgccatgtgcccttgcttgtttgctgaatttgtttccatttcaaagtttgaatatcactatgccgcaatccagtgagaatagagaacaagaacgcacgtttcaaaacatcatccttgcaaggagtatcaaccaacatctgcacttcattcatggtaagcgcaacacgaggtttctctatgtttgttattccctttactttcgcacttatatcaacggtcagatattcatcaatgaatgcctgttttaatccggctttgagtatagagaaataagtcgatgccgtgttttgtgagatagtacctttcttattccctcccattggggcacggagaaggaacatctttatatcttcaagcagtttaacggaaatcgccttgaatggaattggctgcccttgtgaatacattttcaataattcgcctacacgcctccagttgactataatcgaatcggaactattgggatgacgtgtgcttataataccattgaaatacttgataaaatcctgttcgctccgctcattctgtgcagcgatttcgttttccttatcagtgtaaaggatggcaccatcgtattcgtgttggcgtaacttacggacattgtcagcatagatacaagcctcttggtctatcgttgaacggcattggataatcccattcaaatcacgcttaggcttatagttgaatgttccatctggcaaaatacgtgcaatggacgatttgtcccaaacaggcgtggatatagtccggttaatggattccaccacacggcttgcccgtttagaacctcgcttataaactgggtatgattctataatcagataccactcttctttataattcgaccttctgagtttgacggtcactttggtatttggtaatgctttcttcattctacttctgacttatatagattatcaatttcttgcttgggtacatacacatagtttcctatttgtcttgagggaatagagtattttctaacatgtgcccatactgaactgtcattaatatggtacttctcacaaatctcagtaatggtatagcaatcctccggctctaagctgtatattttaggagcaggcttttctttctccgcaatactttccgatctgtttagaaaaagccgttccatttcagagcgtttgatacgtgtgagccttgtacccatattgatagttggaatacgtcccaatttaatcaggcgatacagagtgctacgttccaccccgaacatagcgacggcttcctttacagaaatgtactctctgatgtctgatacttgttgggcaatggcttctaacttcgcgtttctatcctttgcatcctttttgcgtttccaagccactttaccacatttaggggaacaatagtgactgtcaagtgtttttgcgacaaacactttgccgcagaccttgcacttccgtttgatttcaaatccgattgttggcatgttatctacttttaagtatgtattagtatgtataagtgtgattaagtaccacattatctacttttttgtcttgtcgcaaacatgtcgcaaataagagataaaaaagcccatagaaaacacatagcaaccatgaaccccataaacgcaaaaagcgtgcaactcattgagctgcacgcttttgcttattgtttattatctgtttacttatcggaatcacttcacttcctcaaaatctgcatcctgaatatcttctttgttattagaagaagaaccttgattagcctgttgtcctgcacctgcacccggaccagcctgagcgccaccttgtgcaccactctgagcatacatttcagcgctggcagcctggaatgctgtattcagttcagccatggcagtatcaatagcagccaaatcctgtgccttatgagcatctttcagtttctgaagagcagtttcaatcggggctttcttatcagccgacaacttgtcacctaattccttcaactgattttcagtagagaaaatcatagaatcagcttgattcaatttgtcaatcttttcacgttccttcttgtctgcttctgcattagcttcagcttcggctttcatcttttcgatttcttccttactcaaaccagaggaggcttcgatacggatagcttgttccttaccggtagccttatcctttgcagatactttcaaaataccgttagcgtcaatatcaaacgttacttcaatctgaggaacaccacgacgagctggagcaataccagtcaaattgaactgaccgattgatttattctgtgaagccatcggacgttcaccctgaagtacatggatagtcacttcagtctggttatcggcagctgtagagaaggtttcactcttacgagccgggatagtagtgtttgcatcaatcaacttagtcattacaccacccaatgtttcgatacccattgacaacggagtaacatccagcaatacaacgcccttgatttcatctgtcaaaacagcaccctgaacagcagcacctacagcaacaacttcatcaggattcacgcccttagaaggagtcttgccgaagaatttctctactaattcctgaacagccggaatacgagaagaaccacctacaaggattacttcatcgatatcagagttgctcagacctgcatcgctcatagctttcttacaaggttcaagacaagcctgaatcaaattgtgagctaaagcttcaaatttagcacgggtcaaagtcttaaccaagtgcttaggcataccgtctacgggcatgatgtatggcaggttgatttcagttgaagtagaagaagacaattcaatttttgccttttctgcagcctctttcaaacgctgcattgccatcgggtcttttgtcaaatccgcaccttcgtcattcttgaattcctgcaccaaccaatcaatgatcacttggtcgaaatcgtcaccacccaaatgagtatcaccattagtagaaagtacttcgaacacaccaccaccaaattcaaggatagagatatcaaatgtaccaccaccaaggtcgaacacagcaatcttcatatctttgtgagccttatcaagcccataagccaaggcagcggctgtcggttcgttcacaatacgtttaacctccaaacctgcaatctgaccagcctctttagtagcctgacgttgtgagtccgagaagtatgccggaacggtgataacggcttctgtaacttcttgtcccagataatcctcagctgttttcttcatcttctgcagaatcatagctgaaatttcttgcggagtataaagacgtccgtcgatatctacacgtggggtattattgtcacctttcactactttataagggacacgggctatttccttctgtacctgatcccaggtttcacccatgaaacgcttgatagaaaaaatagtacgttgcgggttagtgattgcctgacgttttgcaggatcacctactttacgttcgccaccgtcgacaaatgcaacgatagacggagtagtacgtttaccttcactgtttgcgattactaccggttcattaccttcaaatactgaaacacatgagtttgtggttcctaagtcaataccaataatctttcccataattatatatctttatttatttgttttcaattaaactgatttcttggcgaatggttcacgaaggatttctttttttctttggtgcaccaaccgcacgtccttcataaaacaaacggtatgccaaaaataagaatgtgacaaaggctgacaaaatgactgatttatttgttatatgatacttttagatggatttatataaggcaagaatgtcagaattccaccaaacagaatacttgtcagcatcctaccataatgccataaatgcaatcggcctattttctcgtttatgagaaaataggccgaccatatctatttgaatgtatatggattatcgtttcttcaacaccagcaattcatttccattttcacctaataagtatactttattatctttcatgctgaaactttttgtttcattcaaagcattcagcacaatagtttcagtttccatatcaggacacatcatcatggtagtagcaacattgtcaaatctcaaagaattgggttttccatcttcctgcgttaatgcaccattaatagtattacagcccatattaccgtaaatgcggctttcatccaaattaaaaccgataaaaggagttacctcagccgtacctacaattttctttccattcaccaattcaataacccattctcctgaaagatcagacagtgacacttccggagccgccttcttttccaaagtcatcaacggctgaccatcttgattacatagagttatcacactaggcttgtcagaaaccgtctggaaagaagtcactttatccaatgcacccaataccatctgctcagtcttcatatcagggcacatcatgcgggtacttcctatctgtccaaacttcaatgtacctggcttcagagagtcggcttcaaaacttcccatcatacggttacatccgctatttccataaatacgtttctgagctacatcaaaaccaatgaaaggcattctctctgtagatatcttttgtccatccacctctgtaatattccattccccatccagagaagaaacagacaacatattctttccactaccacaagatacaatcaatgctccggcacaaatagccatcatttctaatactagttttttcatattatttttttgttaaatctgttagtttagtgtgcaaaactaaccattttatttttcactatagcaattatacacaaaaattttatacctttgtatcaatttatatatactaacacttaaagcgatgaaaaagtttttaaccattttaattggggcaacaagctgtagcttatgcacttatgcacaaaacggatatatagtcacgactacttcacaacaaacaagtatttccgtagagtctttggaaaaacagtttataaacgatcatttcaagcattacaacctgtgtgactggacaccaggcatgaaattcatggtgataccggaacgtaaagacatcattattcctccttttaaatcgacggagactaataaggaggtggatacaggagatttaaaacataaaatttttgaatatctaggttcggaaattaccgaacggggttttgtacattttaactttgaatgtgaagggcaacaatattatcacgaacttaaaaacaccactttggaacaatattgcctaaagcccaaagctggtatccctacccttgcctacctgggtgatgtggacatagccaaagaactgctggaaggacaaaccctatatatgcgtaccaataaagtacatatagatgatcccaacagcatatcgggctataaagaggtcccgattggtataaatgaagaagtaacagtaacagctgtcggagtgggcagccgcgcataccctgtaaaaatcgtattccaagacaagagaggaaacacctactatcagccggtagctatatcaaagactaattgtggcatggcagacagtgattttattatggaaaataaaaataaatattttccaaattcatttagcttcagtgatgcaaatacaaaaaaatcaaagaatctgatgagtaaatatggaaaaaaaactgtctatctgaaagcggaaacggaatgtctggatgaaacagacactccggtgagacttccccgatatacacaattcaccatcaaaaatataatctcacaaaacaactctccttacgtctttttagaattggaaaacatagatggaaagaattataagataaaagctgcattcacccatacgagtgtagttgatgtgattttacaatcagacaattattttacggatctattcggcataggcaacttacgagccaagtatccgaatatcacagaagaagtttggaacatgataagccgcggtaaggtacggaaaggaatgacaaccgacgaatgtcgtttggctttgggtaatcccatacgcattcatatagtcacgggtggccatgaaacatggtcctacgaaagaaaaacattagatttcaccaataagaaactagatcatatcaactaatacccaaaatattttgttatctttgccctgtgaacggtaatgtttgccgggcattttattttaacaagaataaaaaacagcaaatgggtaaagtattaattatcggtgcaggcggtgtaggtactgtcgtagcacacaaagtggctcagaatccggatgtattcactgacatcatgatcgccagccgtacaaaatcaaaatgtgatgcaatcgtaaaagctatcggcaatccagctattaagactgcacaggtagatgcggacaatgtagacgaactggtagccctgtttaatagtttcaaacccgaaatcgtcatcaatgtagctctgccttatcaagatctgaccatcatggaagcttgcctgaaggctggagtgaattatctggatacagcaaactatgaaccgaaagatgaagctcatttcgaatacagttggcagtgggcttataagaaacgttttgaaaacgcaggactgacagctatactgggttgtgggttcgacccgggagtaagtggtatttatacagcctacgctgcaaaacatcattttgacgagatgcactacttggatattgtggactgtaatgccggtaaccatcacaaagcgtttgctaccaattttaatcctgaaatcaatatccgcgaaattactcagaacggacgttattatgaagaaggcaaatgggtgaccaccaaaccattggaataccacaaggatctgacttatcccaatatcggtcctcgtgattcctacttgctgtatcatgaagagctggaatcattagttaagaatttcccgactatcaaacgtgctcgcttttggatgacttttggtcaggaatatctgactcatctgcgtgtcatccagaatatcggtatggcccgtattgacgaaatagattataacggagtgaaaattgttccgttacaattcctaaaagccgtactccccaatccacaggatctaggagaaaattatgaaggcgaaacttctatcggatgccgcatccgaggcgtaaaggatggcaaagaacgtacttactatgtttacaacaactgtagccatcaagaagcttacaaagaaactggaatgcagggagtgagctatacaacaggagttcctgccatgattggagccatgatgttcctgcaaggattgtggaaacgtccaggagtatggaatgtagaagagtttgatcccgatccatttatggaacaactgaacaaacaagggctgccttggcatgaagtatttgatggtgatttagaactttaaaaagtgattaacggcccatggtaagtaattcatacctgcggccacaataaccataaatcattaaccactaaaaaaatgaacataggagataaagtcccagaaatattaggcttgaacgaaaaaggagaagaaattcgtttaagtgattacaaaggaaaaaagatagtactctatttttatcctaaagatatgacatcgggttgtactgcccaggcatgtaacttgcgtgataattatgcggaactgcgcgcccatggttatgaagtaatcggtgtcagtgtgaatgatgccaaatcgcatcagaaattcattgaaaagaacgagctgccctttactcttattgccgataccgacaagaagttggtagaacaattcggagtatggggagaaaaaagtatgtacggacgtaaatatatgggtatattccgtacgactttcatcatcaacgaagaaggcgtgattgaacgtatcatctctcccaaagaggtgaaaacaaaagaacacgcacaacaaattttataaaccaacagatttatggcaaaaaaagataacgaagaaattccattctcagcagctccaggtgccggaaatagtgaaaaactgaaagcactgcaagctgcaatggataagatagagaaaacttttggtaaaggctctatcatgaaaatgggtgatgacaacgtacaggaagtggaagtgattcctaccgggtctatcgccttgaacgccgcattaggggtaggcggctatcccaaaggtagaatcatagaaatttatggtcccgaatcatccggtaagactacattggctatccatgccattgctgaagctcagaaggcaggcggcattgcagctttcattgatgccgaacatgctttcgaccgtttctatgcggccaaactgggagtggatgtagataacttatggatatcacaacccgataacggtgagcaggcacttgaaattgctgagcagctaatacgatcatccgctattgatatcattgttatcgactctgtcgcggcattgactccaaaagctgagattgaaggagatatgggtgataacaaagtaggtttacaagcgcgtttgatgtctcaggctttgcgtaagcttacgtcagccatcagcaaaaccaatacaacttgtatttttatcaaccagttgcgtgaaaaaatcggtgtcatgtttggtaatccagaaacaactaccggtggtaatgctctgaaattctatgcttccgtacgtttggatatccgtcgctccactcaactgaaagatggtgaagaagtaatcggcaaccagactaaagtaaaagtagtgaaaaacaaagtggcacctcctttccgtaaagccgaattcgatatcatgtttggtgaaggtatctcaagagctggtgaaatcattgatttgggtgctgatttaggcatcatcaagaaaagcggttcatggtacagctacaacgaaaccaaactgggacaaggacgtgacgcttccaaacaagtgattcaggataaccccgaactggcggaagaactggaaggtttgattttcgcagcactgaaagagcaagaataaaccgttctcacatatatgcaatatattacattcatgaccagtatatacaaaaacaatacatgttaataaaaaaaccgttttaaccataataataaggttaaaacggttttatccttaaacattatttccaatcacaatttttcaacttttataaaagacttgtatcccatattttacaaaaagcatctactttttcaattcaaatcctaacatcagcccgtcataagcttcagctacactgttaagagtggcagctgtagaatttactttggaagccgctccagtaatcacctttagaatagacatcaacttatcggcattaaacacaagactcatactattacctgtcactgtcacataagctaccgtctgtatgcccaacttacttttcataataatcgtcttagcttcctcatcaaaaacataagtgccgcttaccgtacgtcttttcaatatatatgaataagtaccatcctccttgaaaatatacttaatactagtcaaaccaatcttatcatatatagtctgtaatttttcttccacttctttggccgctacctctccaccagcctttgccagtaactgatcactctcgaactgacattcaggagcctgataagaccaagtccccacaatagaatgagccgtagtagccttgttaccaattgccgcctttgccactcctgtcaatatagatttcaaatcctgcgcctcagcatgaacagaacacatacataataacaaaacaactccccaccatttaaaaacattctttttcttcatatacttaattacttataatattcaacgacaaagataaaacaaagagacgaaaagataaataacatcacattgtaatttaacaaaatatgctacgttatgaaatagaacatatataataggaaacaaacgataaaggacaagttgcagccttatcaccacatacttgtcctttatttcaagaaaataccttttaacaatctcttacctcatcacagttatattacaatagataattcaatcattcttatttccattcactatgttgctccaacatcggattcgtatcaatctcaccttgcggaataggccaaaccaaatcttgcgcaccacgaagattaccccgcgaaactactccaaagccatagaatgactggtctttctgcatacgcttttgagcattttcaaattctccccaacggtaaagatctgcaaaacgcaaatcttcaaaagccaattccacacggcgttcgtgacgtacaatggcgcgcaattcttctttattcaaattagttccttccactacttctaccgctggcataccaacacgagcacgaacttcattaatatatcctgttatttcggcttgtggataaccacctttctcaatcatagcttcagcaagtgacaaaagtacctctgcataacggataacatagaagtcaagactaccgtcatattcattaactgtatcttctggagtgtaccatttacgaatacaacaggtagaacttgccggcaaattattagtaaacagttttccgttccattccataccaggtaacatcaatgtacctttcatacgaggatcacgattctcataacgtcccatatccggattagccttcgtatgggctccttgaacaagacttcctttaaataaaggtgacttatcgatgggcaacccatctatacaataaaaatcatcacacaagttcatagaaccttcaatagcattcattggagcagaccaacaaaccccaaagcaacttccttcacctaatcccggacctttaaaatggacactcaacaatacttctgctgccgtttcattttgctctttaaacaaatcagcataattggcagcataatcagttccgtcacccgacttaaaaagctgcacttttcctactacatttttataagccgttattgcctcgtcccaacgttgattaaaaagagcaattcgtcccataatggcataacctgcttcttgggacatacgtcctttttgcgctttccctataactggtattttaggaatccaagtcttcaaatcttccagcaaggacgaaataatctggctacgttccgccttgggagcctgtgcttcagccaaagttaaaggtttcgtcagataagggacatcacggaatacggaggtcagattgcaatacatcaaagctcgtaatgctattgcttccgccttgtatgcatctatcttttcagcctccatcggaatacgttccacattctctaccaacatattacaacgcttaatcacttcataattagcattccagtacatagaaaagcattcatcggtagtggaagaagcacatttcgagatagaacttcccagcatccaatcaccccatgtgtggtctccattatccgtactggtttcacgtcctagaaatccaaacttccagccatcaatattgtcatcatataaattctggctctgcatggcatcatagcaagctgtcaaagccatcaatgcatccgattcggtctgccaataagtggtttgagaaggctgattcggagaatccgtctgcaaaaaactatctgaacatgcactggtaaccaataacactccagaaaaaaataaaactctgcatatattttttgtactttttaccataatgtatatcctccttataagttagaattgaatatttagcccaaatgaataagtgcgcatattgggatgtacgtcatttctagcatcacccgatgttttttccggatcccagtttttcaaagacgtaaatgtcaaaaggttgcttccggcaaaataaacacggacactggaaacacccatcttagcaagtccaggctgacggaatgtatagccgaattccaagttcttcaaacgtaagtaactggaattttctaaccagaatgaagaataagaatcattcatagtattacccaatgctggcatagaagcatttacgttgccggcagaataacgatccaaccaacgttcggttaagttaccgcgaatatcggtagaagtttcccaactgtaacggtaaatacctcccactccttgccaaaaagtagacaagtcaaaattcttccaagaagctcctaaattgaagctataagaatatttaggaaaaggattgccaataatatcacgatcatcagcagtaatattaccatcatcattcaaatcagcatacataatatcgcccaatttaggagccacaccattttgtttaatgatttccccttttgaattagtacgctgtaaatcagcttctgtacggtacataccaatcgctttatatccaaaataagcgccaataggattgccaatacgattgattgtttgcccacttattgtttcttccaaaccgcccatttccagaatttcgttcttcacgtgtgacaagttgaaacctacattccaaacccaatcgcctttactatccgagtaattcacattccattcccaaccacgattgcggacagcacccacattctgataaggagcattaagagaacctaagaatatgcctggcatagctaattgcatcaagatatcagaagttttcttatcaaaccattcaaaagtagtctgtatcctattattaaagaatccaagatcaagggccacattgatggagcgggtcgtttcccatttgatgtcttcatttggaacagaagtctgtaccataccagcctgtttgtccccaccttggtcaaagaaataatttccgcttgcgcccaaagtagccgcataagcataattaccgatttcctggttacccaacttaccccatgataaacgcaactttccaagggagaagtttttatagtctttcattaattcttcattcgaaaacacccatcctcctgatacggaaggaaatgtagcgtaacgattggctttaggcatacgtgatgaaccatcgtggcgaatattgaactcaaacaaataacggtcatcataaccgtaattcacacgaccaaaaaatgactggagtttatattcttccgaattgccttttgcacccggattaattgttcctccatcaagttcataaatattttctgtaggaaagccctgtatggaagcagtcgttttataaaagcgcgagccaataacagagtgccctaacaacacattaacattatgtttatcaaattgtttgttataagtcaacaggttctcactcgtccatgttgcattgcgataccaataatcctcctccttattcgtttcccctgccgcttttctaatatttccttctgcatcataacgggcaggagatttgggagaataagatttcgttgcatttaaatcaaaagcataagcaaaactggtctggaacttcaatccgtcccataaatcaatacctgcaaaaaccttaccgttaaaacgccaatactcattgctgcggtgccctaaagacattgactctacaggattcttcatcagttcggcactcaatgacgaaccatctacatagccgtagtgtccgttagaatacatcaccggcacagtaggacgagtaaaccaggatacataacgcatgattccaccttcgccggaaggtgcgacagcaggagtagtcacattattcttattaccggataagttcaatccaaaagtaaaacgtttgtaacgagtatcaatattcgaacgaaaagaaaagcgttctactcctgtcttcatcatgataccatcttgattggaataggccaccgaagtcataaaacgggtattttcattacctcctgatacagacagatgatgctggtgcatactagcattacgcaatacagcatccagccaattggtatttgcataatgatccggatctgatccgtcttgcaacttttgcaaagcttccggtgaaaaagttccagtgctcacttcgtttttcatcaaagcccaattataaccatccacataatcgggaacaatacctggggtctgcaaagtataactacctgaatacgaaaccttcactttgcttgatgcctgtccccgcttagtagtgatcaaaataacgccattagcagcacgcacaccataaatagctgccgatgccgcatccttcaatacagaaatgctctcaatatcggcagaagggatttctgcaatttgtgaaatactaccttccaccccgtcaatcaacaccatcggattattattcccaaaggtaccaataccacgaatcctgatttctggattatcattaccagcttgtgcaccgttctgagttagtactaaacctggcaaacgtccctgtagcaaagtagttgtattagccaccggaatatcttgaatatcttttgctgatacggaagcaacagatcctgtcaaattcactttcttctgagtagcgtatcctactaccaccacttcgtccagctttttggagtcttcttccaaaataattttaaaattatttttactccctaccggcaggatcacatcctgatatcccaaaaagctaatcactaaagactgggaaggttgcaccttcaactgaaaagcaccgtctatatcagtcaccactccctgcatagtaccctgtaccattacactagctcctataatagactcaccggatgaatcatacaccttacctgtcactatacgttcctgtgcgtataccataaatgaaaatatcatcaggacgcctgccaaaaccacgcgaaataatttttgcctttgtcttttcataatttcaatttaattaagttaataggttacttataatttgtattacaacaaatatcagaatagctttatttccattgataatgacgtacccagtccacttccatctccactggtaaatccgtagagtccactggtcctacccaagtacctcctaattgcatatcaatcaacaaatattggggaatatcaaaaggaaattgaccttcttgttccgtttcgatacgaggataaacaaaatgtcgttttccattcacatgaaacaccaaactgtccggccaaaaatctaccccatatacattaaagtcctcaggattaatggatgtagtgcctccatgtttcggattattctctatccccaatgtataagtatagtgcgaatgcacggtttgataaacaatagaatcataattcaaacgttccataatatctacctctcctcccataggccaaacatatttatcaatttcataaggcaaagtccatatagccggccatgctcctctcgccccatgcaatctagctcttacttcgatgcgtccccgatgaaaagcatgcttgtcttttgtccacaatcccccagtcagatacttcgccgtatctacatccatattatcattcacaattccctttaatattaaacaaccatcacgcatttcataacaacgattatcaaatgactgagtattttgccaatcaggtcttccgcgaggtatgcggctccatattgtggtatcaggttccgcaccatcaaaattatcttcccacactaattcccatttcggtgtatgagtacaagcaagcataccacataccgacaataataaaagtataacatttttcatactacattaattttggttcacaaaacttattttaaaaatttaattggcaaacttagtctatttatcaactaaagagatcagaaattgtataaatcaagtccatttctgtctaataaggggatatttctcaatttttatttctaaaatatcttagtattcttattacttcatactgaaaaatagtccttaaattcttatcaaaagaaaaaaaatgtatttttgcaaaaaataaaaaatacaatgtatcggaccttaattatcattttattcttatgggcagacacaaaattgttctcttccgaacacagtgtcaattattcgttcacccagctctctatagagcaaggactttcccaagctactgtccaatccatcctgctagaccataaaggtactttatggataggtacccaaaatggattgaacagttatactcaagagggaatcaaaacctatctgcaccattcagacgatccccactctctacctagtaattatatcaatcatctgacagaagactcattaggaaacctttggatagcaactcccaaagggttagccctttatgatgccgaacaggaccgatttaatactaccatttcccaagcgatctattcttctatcaaagtaaaaggtggaatatggtttggcagcgagaataccatatattgctacgactatcatagtaaaaaaacaaagatcattcacattaaaaaacaagaaaagaaaaaaaatatcaacatggtagattatagaatccaaaaaatggtttatctcgataaaaacaaaattttagtaggtacccgaagaaaaggaatctactcgtacaactgtcaaactcaacaatttagtctttttattccaagcagtcctaacctgctgacatcgttatacataactcttgaccagcatatttacacatccttttatggatctggactatattgctatgaccaaacaggaaaaatccaagaacactatactcaaacaaattccggattaaacaacaattatattttagacataacagaacacaatggcaaactatggttgtctacagacggaagtggcatcaaccaatttgctccccatactcaacaattctcacaacttcaacatatagtaggagactattcttccctaccagtaaactccatcaccttgctctataaagaccaagaaaaaaacttatgggcaggaagcgtacgcggaggcatattctgtattaaagaaacgtacattaagacatataaagatgccgttttaaacaatcccaacggactcagtgaaaaatcaatcatcagcctttacgaagaaaagaatggaaaagtttggattggaactgatggaggaggtatcaacctatacgacccttctactgacaaatttacccatttcccctcaacctacggagataaagttatttccattgctgaaatatctgaatctgaattaatggtttctttgtataccaaaggcattttcctgttcaataaaaagacgcagcaatatcgtcctttcaccattatagataaagagaccaactataaagaatgtttttatggttaccttcctttggccaatcaagtggcaaacaacaaaatatatataatcagtcgtaatgcatatgcatataatacacataaccacacattctcaaagatgcaaacagatcgtcactacgacttctctaataatgcactttgtctatcatactccaacgataaattctctcttttaaaatacgctcaccaagctttttgggtagatcaacaaaatgacagtatccgattactattcgagttggaaaaaaatgaaaccatcacttccatgtcttatgacaacaacgatataatatggaccggaaccgacaaaggacttggattcttcgacttgaaaagtcgaaaataccatcgcatacacaccaaactatttaataacatatccttcctcattgccgatagaaaaggacgtctatggatctgtgctcaaaatcaactatattcttatattatcaaagaaaataaatttactatctggaatagttctgatggtttcccatctaacgaaattttattcgcataccaaaaacaatctaataagaattacatctatctaggtggatccgaaggattggtaaaaatcaacacaaacattcccgaaactgaaactcagataccagaaatatacctgtccgacattctccttaacggtagtccttatttaaaaaaaatcaaagagaatacaataaacataccttggaactacaattctctttccatccaccttcgaataaagaacagagacatattccaaaaatacctgctccgatacataattgaaagtagaagcaaacaattgattgaaacttacgatccaactttaaatttatcctctctatccgcaggcaactacacaatacgggtttcttgcaatactaaagacgggaatcataccacaccccaaaaattgataaacataatcgttactcctccttggtataagaccagctggttcatcggcatagccgccatcttgtttattattaccacagccggtataggctacatttatttccgacggaaagagaaatatatgaaaggcaatatgaaccacttcctacaagctatattgaacgacatcttaaaaaacaaagaagaaaaaataccagtcgaagaaaacattcctgcaacggaattatcatctaataggctagtaaaagaaaaaaacgaaaaaaggatagaaacagaacagtctcaaaagaaaaacagtaaagaagatgaggaattcatcgccaaactcaatatacttattaatgaaaatatggctggagaggaactttccattaagtttctcacagataaaatggctatgagcagagcatccttatataataaggtaaaacttctaaccgggttgggcgttaatgactatatcaataaactacgcatagaaaaatctgtttacttgcttacaaataccaacatgaatatcaacgaaatatcttacgaggtaggcttttcctatccgaggtatttcagtacctcctttaaacaagtaaaaggaatgacacctacccgatttaaagaagaaaataaaagaaactaatatcaatgacgcaaatgtacgaatttattttaattttattcgtaccaattacgtcattcatatttcaaaaaaagatccaaaatttgaagttctctcttatcataaaacatttccttaacaagccttgaagctcatatccaatccttttacagaatgggtcaacgcaccaaaagaaatgaaatccactcctgcctgcgcatagggtaacatagtatcgtaagtaataccaccagaagactcggtttcgcaacgtcctcctactatctctacagctttacgagtatcttcaggtgtaaagttatcaaacataatacgatccacaccttctgccaacgcctgattcaattcgtcaaaattacgcacttccaattcaatcttcaagctcttaccctttgccttacaatattctttagcacgggacaccgcattgtgtatgccgcctgcaaaatccacatggttgtctttcagcagaatcatatcaaacaaaccgatacggtgattgcatcctcctcctatctttacagccatcttctccatgatacgcatacccggagttgtcttacgggtatccagtacacgagttttcgtaccttccagtttcttcacatatttattggtcatagtagcaatgccactcatgcgttgcatgatattcagcatcaagcgttctgtctgaagaagtgactgaactttaccttccaccatcatagccacatcacccggtttcacgtgagttccatcttgaatgaacacctccaccttcattgtgggatcaaaacggcgaaatacttctttagccacttcaatgccagctaagataccttcttccttaatcaacaactttgattttcccattgcatctgcgggaatacatgacaaggtagtatggtccccatcacctatatcttcagcaaaagacaggtctatcagtctgtctattaagtcttttactactaattcgtccataatgttatcgtttttttatgaattgataggcaaaggtagagattttccgtatttttgcaaagtaaaccagaaaagaacgtatgaaatttacattattagtagtaggacgcactgtcgaaaaacattatatcaccgctatcaatgattatgtggaacgtaccaagcacttcatttctttcgatatggaagtcatccccgagctcaagaataccaaaaacctgagtatggagcaacaaaaagagaaggaaggagaattaattctgaaagctttgttgccgggcgatgtagtggttttattggatgaacatggaaaagaattccgttccgtagaatttgccaactggatagaacgcaaaatgcacactgtaaacaaacggttagtattcatcattggggggccatacggatttgcacccaaaatatatgatgtaacccaagaaaagatctcattatccaagatgaccttctcacatcaaatgatacgccttattttcgtagaacagctataccgggcgatgactatattgaacaacggtccttatcatcatgaatagaaatatatagcggttagtgattaacacctgcggcataatagcgcagtccattcatcactaaccaccaatctctccctattttccaatttcaaagtccacacacactggcaaatggtcgctataaccaccatgatatttctttccccaataggtacgtgatggaatattaccaccatatttttcatcctcttccagcaggaacggatattttaaaatctgtgccttatcatatgaagtgcgcatactatcatgcccttgtaacaaaaaaccggaaacaatcagctgatcaagtactccccactcacctcgataacgataggttccctccttacgcccgtccatcagattatataatttcttggcctgcactccacttttcggagccacagcccccaatacttttgcaatagaattattagtgggataatcattaaaatcacccataatcattacattaggatgctgacggatattcataacagaatctgccgctatcttcaatatctgcgccgtaaaaaggcggtagggttcactcttctcctcaccgcctgcacgagaaggcatgtgacacacaaacacatccaatgtatctccggaagctacctgccctgtcacatgaagtatatcacgtgtaggccgacgctctatttccttataaggaacagaaatacagtttttccctactaatttaaaggtaccacgttgataaagcaacgccacgtcaataccacgctcatcaggagaatcagtcatgacatagcgataacccgcctcgcgtaatggcgagttttctgtcagatctttcaagcaatgatcattttccacttcacaaagtcccaccaaatcggggacattttcctcacccgtggcaataataactttagctatcctagccaatttatcatgatagcgcgcttgcgtccatcctttcggagcatccggcaaaaattcataatcatttttcaacgtgtcgtgctgacaatcgaacaaattctctacattatagaacattacccggaacggttcctgtgcatacgtcacccctaccaggtagcacaaacaaaggaatagaattgttttcttcatataaattattttgtcggtatattaaccaatacatccagcaaatgacgccagaatttatctacagtaggtatcagcatacgttcatcaggtgaatgaacaccacgcaaagtaggtccaaaggaaaccatatccagtgacggatatttctcaaggaacaacccacactccaatccggcatgaattgcctttactttaggttccacaccaaaaagttttttatagctatctatcgcaattttcaaaacaggagaatccgtattcggtttccatcctggatatccgtcaccagttattacttcagcacctcccaaaagaaaagcagaacggatcatctcggacatattcttgcgtgatgaaagaatggagctgcgctggctagtcactattttaatcttgtttccctctacctgtttgatggaagcaagattagacgaagtttctactaatcctggaatatcctgactcatggcatacaccccattgtgcacagcgtaaacagctctcagaagatgtccggcagtagtcatatctatcgcttccttacaaggggattcagaagagagttcggttctcaagttcggttccgtcgcagcatattcattctccagttctgcagtatagatattcaaatctacacgaaccgattccttatccttcataggtaccgcacataatgcctgtgcctcacgaggtatggcattatgcaggtttccaccatcaatctcacataaatataaaatatatttagaagccaactgagtcagaaaacgattcagcagcttattagcattcgctctacctttattaatatcatcaccggagtgtccacctgtcaatcccttgaccgttacacggaaataaaaataatcctgtggagcagaaacaggctgataagtaaattccgctgtagtatttgcaccaccggcacagccgatgaataattctccttcatcttccgagtccaaattaatcaaaatatcaccagtcataaaccctggtttcaatgcaaaagcacccgtcaatccagtttcttcatccactgtgaaaagacactctaacggaccatgctctatatcagtagcagccaatatagctaattctgtcgccacaccgataccattatctgcccccaatgtagtacctttggctttcaaccattcaccgtccactactgtgtcaatgggatcaattagaaaatcatgctccacatcactgtttttttcacaaaccatatctatatgagactgcaaaatcacagttttcaaattctccttacccggagtggcaggttttttaattaatacattgccaacttcgtctgtcttagtttctaaaccatgttttctaccgaaggctttcaaataagcaattattttctcctctcttttcgagggacggggtacctgacatatctcttcaaaataataaaagacagatgccggctttaaatcctttttattcataatcatgttgtttaggcaaattcagtttccaaatttgcaaaaaatagttaaataattctcttaaataggacacttcctcttttttaatgagaaaagagaaagctaaatcattgcaaaattctatatttgttccgcaaatttagtccgcagatacgaaatgcttcaataaatttggcatttcccttgccttacactaactttgcaccacaaaaataatagaaatgcttgatactatccttataactgtgttaatagttgctatctgtatagcattattgtctatcggaatctttctaaaaggaaagtttccaaacacacatgtaagcggtaataaggcactccgtaaaaaaggagtaggatgtgtacaatcacaagatcgtgaagcacgcaagcctaataaaaatgccatagccgaaattgaaaagcaaaacaaaacggataataattaataaacaatacgtgaaaaagattatgaaaagaacaaatttcatcctgaatggatttctagcactagccatcgtgttagtgtttgcacaatgtagcgacaacaacaacgctgcaacttcttccactgctccggctgtcggcgttgctggttcttcaaacatgaaaatagcttatgtggaaatcgattcactgttgactaagtacaatttctggaatgacttaaatgaagtgatgatacagaaagaagaaaatatccgcactactttaaatgaaaaagcaaagaagctggatgctgatgctaaagaattccaacgcaaactggaaaataatggcttcgctacacgtgaacgtgctgaacaagaacagatgagactgatgaagcaacaacaagaactgcaggcactgcaacagaaactaagcgacgaactagcttctgaaaatcaaaagaacagcttgcagttacgtgattctatcaattcattcttgaaaatttataatcaaaacaaaggatatgatctaattatcagcaatacaggatttgacaatttgctatacgctaatccggcatacaacatcacacaagaaatcattgatggactgaatgcacgttatactccctcttctgtaaaaaaataatagttcatcaaccttataatacaaggaagcggtgtcaaaacaaaaatgactgttcctaaaagttacagatagtaattataacacttaaaagggtcgtatcaagctctgtatggagtaatgatacgaccctttctttagtcttttaggatgctcaaatttcagattataagttcatatttccaaaaactaatttggacacacccacttacttttaaacaaaaaacacactataaacgtttttattataataaaaataacgaaaggagaacattatggaaagatttgaagatttaatcacctcaaacatccctgtattagttgatttttttgctgaatggtgcggaccttgcaaagccatgaaacctattttagaagaattaaaaggaataaaaggggaaaaagtaagaattgtcaaagtagatgtagacaaacataaagaaattgctacatactatcagattcagtcagttcccacactaatgatttttaaagacggtaagcaattgtggcgacaaagcggtgtaatgcgtgccaatgatttaagcataattctagcccaatatgaataaaatatgaaaaaaacaatcacgtgtcttttattaactaccggattaacaggatacctcagtgcccagactcctttccgagataagtcagataaaaatgaaggaaaagtcatacatatggacaaacaaatgttcttggataatatatttgactacacctccggttccactgactggaaatacaaaggagagaaaccggcagttattgatttctacgccacatggtgcggtccctgccgtatggttgcccctctgctaaaaagtctggccaaagaatacaaagatcaaatcgtagtttacaaagtagatacagacaaacaaaaagaattatctgctgccatggggatacagtcactgcccaccatcatctttatccccaaaacgggacagccgcaaatcattataggagcggccaataaaactactttcaggaaagctattgaagaagtattactgaaagaatgagaaacaaggcctatacatctctaatctaaatatagccaataaaaagagaggggacaataataattactccccctctctccatttatactataaaaaatcgtatattatttcttgaaatatctgttgtacaaaccttcaaaacctttaccgtgacgagcttcgtccttagccatttcgtgaactgtatcgtgaatagcatccaagttcaaagcttttgcacgagtagcaatacgtttcttgtcagcacaagcacctgactcagcattcattctcttttccaagttagtctttgtatcccatacacagtcacccagcaactcagcaaacttagcagcatgttctgcttcttcccaagcataacgtttgaaagcttcagcaacttcaggataaccttcgcggtctgcctgacggctcattgccaaatacataccaacttccgtacattcacccatgaagtggttgttcaaatccttaatcatttcttcatcacaaccttttgctacgccgataacgtgttggtctgcaaattccaagccaccttctgtttctaccatttcgttaaacttagaagcaggcgctttacacaacggacatttttcaggagctgcatcaccttcatgaatataaccacaaactgtacaaataaactttttcataatttctttttttattagttagtcaatattttatttattagttagtcatctactctctatctttctaacttctttctttgtcttctttagaacaaacggggcatatacctttataatattggtgaatttcatccaccttgaatccattcatatcaatttgctctacttgcttcacttcattactgtagggcaaatcaaatattttaccacatttcttacaaaggaaatgagcatgcagggaagtatcaccgtcaaaacacgcattcttttcatcaattgtaagcattaaagctgctccatgctcgacaaagagtttcagtgtattatacactgtagtcttggacaaggttggaatgtccttgcatagcgccaaataaatctcatcgatagaaggatgagttttatgggccaacaaataatccataatagctatgcgctgtacggacggcttaatgttataactgataagataatcgtaactcttcatatattccctttttgtaactattacaattttatttcatgtgcaaagatagatagttattcgcaacaaacaaataaatcacgtacttttttttatttttttttatttaggggtataaatcgggaaagaatgattaattttgcaagtatatataataattaggtataatatgaaatacggttttgtaagagtggcggctgccattccgatagtgaaagtggctgactgcaaatttaatgcacaacagattgaaactcaaattgccatagcagacgggaaaggagtacaaattatcatttttcccgaactaagtattacagggtatacttgcgccgacttgttcggtcagtctttactgttggaagaagcagaaatggctttaatgcagattatgaataatacccgacaaatggatatcgtctccattgtagggatgcctgtggttatgaattccacgctgctgaatagtgctgttgttttccaaaaaggaaaaatactgggtattgttcccaaaacatatttacctaattataaagagttctatgaacaacgctggtttacctctgctctaaaccacccagatggtaatgtacgtctctgcggacaaaatgtaccggtcagcgccaacctgcttttcgacactccggaaacttgctttggcattgaaatctgcgaagatatgtgggcccccattccccccagttccgcattagcattgaaaggagcggaaatcattttcaatatgtctgccgataatgaagggataggcaagcataattatgtccgttcattagtcagtcaacaatcagcacgctgcctggcaggatatgtattcagttcatccggtttcggcgaatcgactacagacgttgtttttgcaggcaacggactgatatatgaaaacggcacattacttaccgaatctgaacgtttctcattcaaagaacagttagtcatcagtgaaatagacgtagagcgtcttcgtggcgaacggttgaccaataccacttttgccgccaatatcggcaactgcccgggacgtcccgccatccacatcagtacagaatttgttaacacacgcgatcttagtcttacacgcagtatagaagcccatccttttgttcctcagggcaaagaattggatgagcgttgtgaagaaatttttgccatccaaatagcagggcttgccaaacgtttggtacacactcactgcaagactgtagtagtcggtatttccggtggtttggattccaccttggcacttttggtctgtgccaaaactttcgacaaattgaatttgccacgaaaaggcatcatcggcatcaccatgcctggttttggcactaccgaccgcacttataataatgctctccatctgatggcttcattaggcgttactattaaagaaatcagcattaaggaatcctgcatccagcattttaatgacatagaccacgatatgaccatacacgatgtgacttacgaaaacagtcaggcacgcgaacggactcaaattctgatggatgttgccaaccaactgagcggtcttgtcattggtacaggagacctttcagaacttgccctaggctgggccacctacaatggcgaccacatgtctatgtatggagtcaatggaagtattcccaaaacattggtcaaatacctggtaaattgggtggctttgaatgacatggataatgaatcacgtattactctgctcgatattgtagacactcctatcagccccgaactgattcctgctgatgaaaacggcaatatcaaacaaaagacagaagatttggtagggccatacgaactgcatgacttcttcctttatcaattcctacgtttcggttttcgtcccgccaagatattcttcctggcaagtatcgcttttcgtgatacatacgatgaggcaacaatcaaaaaatggcttactatattctgccgccgtttctttcaacaacaattcaaacgttcctgcctgcccgatggtcccaaagtgggatccgtatcactcagtccccgaggtgactggcgtatgccaagcgatgcaagtgcagcttcatggctgaaagaatgcgaagagctataaaccatataaaaaagtaagttagcttcaaagacaaagtaacttaacttagttgggcaaataagttaagttactttgtctttgaagctaacttaaatacatcccttgcttgagggtacttcaaaatagtaaatatctcttcgcacagccatctttatggcacgagccaaagctttgaaaataccttctattttatgatgctcattctgcccctcggctttgatatttaaattcatacgagctgcatcactcaatgatttaaaaaaatgaggaaacatctcggtaggcatctcccctattttctctcgatgaaactcagcatcccatactaaccatgctctaccgccaaaatccaaagctacccgacaaagacaatcatccatgggcaagcaatatccgtaacgctcaatgccacgcttgctgcccaatgcccgataaatacattcacccaaaacaatggcagtatcttcaatagtatgatgttcgtccacttccaaatcaccttttactttaatggtaagatcaataccaccatgttttccaatctgttccaacatgtgatcaaaaaaaccaatacctgtagaaatatcacactttccgctgccatctaaatttaagctgatataaatatccgtttccttcgtagtacgacggacctccgctatacgttctccggcaaaaagaaattcagcgaccttatcccaatctgtagtaaccagtacacaataggattccagttctttttctttcagaatatccatattatcttgcagcaagatagccttacatcccatatttttagccagttccacatctgtaacacggtcaccaataacaaaactgttagccaaatcataatcaccggtaagatattttcccatcattcctgttccaggcttgcgggtaggcacatggtcttccggaaaactgcggtctatcaagatatcatcaaaagtgataccttccccctccaatgtcttcaacactaggttgtgcaccggccaaaaggtatcctcaggaaaagaagaagtaccgaggccatcttgattggtaaccatcacaaattcaaagtcgagcttactgcggataaatcccaaattacgaaataccttaggataaaactccaatttatggaaagaatccaattggtaatcaaccggtggctcgataaccaacgtaccgtcacgatctataaacaacgctttcttcatatttcaacattcataattcttcaatgcttccaacaacatatcattctccggacgtgtaccaatagtcacacgcaaacaatcacgacataaagaaatattggtacggttacgcactatgatacctttacctaccaaataattatatattttcttggcatctgtcactttagctagaaaaaaattagcatccgtaggatagattttctcacaacaaggcagttctacaaattcattgaccaaacgcgtccgttcttccaataacgactttacccaacgttctacctcataatgccgatgcaacatcataacagcctctttctgtgtcagcagattcacattatacggatatttaatcttactgaaaatagagatgatttctttagacgcaaaggccatgcccaaacgaatggcagcacatccccatgccttagaaaaagtctggaagacaatcaaattaggatatttatctaaatcggcaaggaaagacggcgcatcagaaaaatcggaataggcctcgtctataatcaccaatccctgaaaagtatccagcaatttttccatttccctacgatccaggttattaccggttggattattgggcgagcaaagaaaaaccagtttggtgtgatcgtctgttgccgccaatagtttgtcggcactgaactgatagttttcatccaacaacaccttgcgatattctacatcgttgacatcggcacacacctgatacataccataagtagggtcaatagccgctacattatccacccccggaatacagaacgcgcgatataccaagtcaatagcctcatcactgccgtttcccagaaagatcgtatcggggtctacctttttaataggagctatcatattcttcagttcccgctgcataggatcaggataacggttattaggtgtattgtacggattctcattggcatccagaaaaacagatgcctccgctccattatattcgtcacgtgccgatgaatagggtttcaaagcccaaatattcgggcgcgtcaattctttcaaatctttcatctttatactgtttttaatcttacggttactgcattcttatgcgcacccagttgttcattagccgccatcacctcaatagcaggaccgatattctgaataccctcaccattaatctcctgaaaagtgattttacggataaaactatccaggctcaccccactatacgctttggcgtaaccattggtaggtaaagtatgattggttccggatgcataatcaccggcactctccggagtaagtgaacctagaaatacagatccggcattgacaatacgctctgccagttccatataatccttggtctcgataatcaaatgctcgggagcatattcattcgtcagagcaattgcctcatccatatccctcaccaaaatcaatttgctgtttgccaacgacttttcggctattttccatctggtaagcaaagccaactggcgttgtacctcatactccacctccttcattaatttctcagaagtagttatcagcatggcctgactatcaactccatgttccgcctgtgaaagcaaatcggctgccacaaatacaggattagccgtctcgtcggccagcacttcgacttcagaagggccggcaggcatatctatcgcaacatcccgcaaagaaacctgctgcttggcagccgttacatattggttacccggaccgaaaattttataaaccttaggcacactttccgttccgtatgccatagcagcgatggcctgcacccctcctgctttgaatattttatttactccggccaattttgccgcatacaagatagcaggatgaacctttccttctttatcaggaggagtacaaagtacgatttccttgcaacctgcaatctgtgccggagtagccaacatcaatacggtagaaaataaaggcgccgtgcctccgggaatatacaagcccaccttttcaatagcaacagccttctgccaacaagttacaccagatacagtctgcacctttttcccttcaaatcgctgagaattatgaaaagtatgaatatttttctgtgccagcataatagctgccttcaattcaataggtacctccttttccgcttcagcaatttccgtttcagtaacccccagtaagtccagtttcaccttatcaaaacgttcttcatattccctcaccgctttatctccttccgtcttcactttatccagcacttctttaaccgtatcgcgcagcgtgtctgtatttaatgccggacgacggagaatttccacccagtctttcttttcaggatatattattttcttcatacatgtattcttttataagtttacaaatctcgcctgacgtatggaccggctataatatcattttctcaatgggcaataccaaaataccttccgcgcccaatgccttcagttttccgatgatctcccaaaaacgtttctcgtcaagcactgtatgtaccgaactccatccttcttgtgccaatggcatcacagtaggactcttcatacccggcagcacttcgataatttcttccaaacgctctgtcggagcattcatcaagacatatttcttgtcttcggcagctttcaccgcttcaatacggaacaagagttcattcaaaatctctttcttctcctcagacatattcttattgcctatcagcaatgcctcacttttcataaccacttccacttccttcaagctattgcttaccaaagtcgatcccgaacttacaatatcaaaaatagcatctgccaaactgattcccggagcaatctctaccgaaccggtaatgacatgaatatcagaatgaataccattccgttccatgaaatctttcaaaatgccgggataagaagtcgcaatcttgcgtccttcaaaccaagacaaacccggatagtccacatctttaggtatagccaatgacaaacggcacttgctgaatcccaaacgtttaatcacctcagcgtcttcttttctctctacaaactcattctcgcctacaatccctaaatcagccactccaccagccaccgactgaggaatatcatcatcgcgaagaaaaagaacttcgataggaaaattagatgactgtactaaaagaattcttttagaagcggagattttaatatccgcctcttgtaataatgccattgtctcttcaaacaaacggccttttgactgtactgcaattctaagcatgattctatctgttttttaattattaaccggcaataaaaagggcttaccgttttcggcaagccctatatcatcatactacaatatcatcttagcccaccgagttattcgttaggaaaatgatgatgatgtgtagctgttctaaccatagtcttttctttttatttgcgacaaaaataaagtttatatttgatatcagcaaataattatcgcaaaaactttattttttctttcaaattaaaggtattatctcatcttgctccacctcgcagctcaaaaaatgcatttcttccttcgccttctcttgcggaaaagtgaaataagtgcatagagccttggtgcaaagttcctctttattattataaatagccgcttctacaaatacgatattgcgcttcctctcctttatggaggctttcaatacaatatacgaatcgttagtattaacaggcttcatataacgagtttccattttggacgtaacaccggtagtctgtagtttacgcaaaactacccatgcacaaatctcatccaacagcaccgcctgaatacctccatgcaacgtatcaatccacccctgaaactgtggctgaggtttccagatactgattacctcattcccgtcttcataaaattccatcttcactccggcgtcattattaggagcacagccaaagcaattatatcctttcatccccttccagggattgattatctttttcataagctatcttttataattcgtaatccacacaagcacgatcagccttaacctcttttaagaggccggcagcagctacatgatccggatgaacggcataggcattgacatctgccagcgtatcgaattcactatccaaacaaatatcccatttttcagcagaattggtattcagccccacaaatatatgacggataaaacctatcttgaccggcaaagcttcaatagccgctttaaaatcattcatcactttcaatttttcttcttgtgaaagagtttctttcaatttaaataaaacaatgtgcttaaccatacttgatattttaattaattatcctacttttgtaattgacacagggcttaaagtatttagcctgatgcaaaagtaacagttttgttttaaaatacattctattattatgataattattggcatagccggcggaaccggttcaggaaagaccactgtagttagaaaaatcatagagagcctgcccctaggttccgttgcagtcattccacaagattcatattataatgatcagtcatccattcccttggaaatacgtaaacaaaccaatttcgaccatcccgacgcttttgactggccgctctttgaacaacagatagccgaattacgtaaaggacatcccattgaacaacctacctattcttatataatatgtacacgcctgcccgaaaccgtccatgtagagcctaaggaagtcatcatcgtagaaggtatcatgagcctctatgataaagagttacgcgatctgatggatttaaaaattttcgtggatgccgaacccgatgaacgtttgctgcgtgtgattacccgcgacatggtggaacgcggccatcccttggaaatgctgatagacaaataccggaacattctgaaaccgatgcatgacgaattcatagagcctaccaaacaatatgccgacattattatccccaatggaggcaacaaccaaaaggccattgaaatccttaaactatatattgaaaagattttaggaagatgaaaaatgtctggctattagtccttgcctgtatatgcatgacagcgtgccgcaaccggcaacaatctgccgaagtgacaaattatgatttgccgcaaataaaagacagcggagaattagtagccctgaccttgaacagttctacctcttatttcgactatcggggcgagcctatgggattccagtatgagctggccgatcagtttacccgctcattgggcgtaaagctgaaaataaaagtagcacagaatgcccgtgatctggtccataaactattacaaggagaaggagacctgatagcctataatctacctgtcaccaaagagtttaaagatagtgtagaattttgcggggaagatattatcacccatcaggtattggtacaacgcaatactcaaaaaaagaagaaagcactgaataatgtgacagaattaatagggaaagaggtctatgtaaaaccaggaaagtatctggaacgtctcatcaatctggataaagaactgggtggcggtatattgatacacgaagtcaataatgacagcatcaccaccgaggatttaatcatgcaggtttccaatggtgagatagattatgccatctgtgataacgaccttgccaaattaaacaagacttattaccccaatctgaatattgacctggctgtcagttttgaccaacgtgcctcatgggccgtacgtaagacctcaccgctactaggtgaagctgctactaaatggcatcaggaaaatataacttctcctgcctatcaggccagtagcaagcgttattttgaaataagcaaacggacacctcacggttccatcttgtccgtcaaagacggaaagatttcacacttcgacactctattcaagaaatatgccaaagaaatagattgggactggcgtattttagcttccctagcctatacagaatctaattttgatacgacagccgtatcatgggcaggcgcgaaaggattaatgcagctcatgccccggacggcgcgtgctatgggagttcctcccggtaaagaacagaatccggaagagagtataaaggccgctgtgaaatatatcgctgccacttcccgttctttcaacgcaataaaaaatgaaaacgaacggatgaaatttgtcttggcggcttataacgccggaataggacacgtactggatgccatggcactggctgaaaaatatggcaagaataaatatgtatgggataatagcgtagatgactatatcctgcttaaaagtaatgaagaatatttcaatgatccggtttgtaagaatggatacttccgaggggtagagacttacaatttcgttaaggaagtaatgagcagaggggaagtgtataaaaagaaaatcaaagactgacagccactccttttattatttcaggtggactttaaaaaccactccgccggaaaagtaacggcagcggttgaactctatcaccgcattgatataatctttccaaaagctgtattcagcacctatattaattgtacgggcgtcatattcagccataaggttcagttccaaccggttccgtagggttgaaacttcagttccatcaggctggaactaaggtttcaccagattgtaactatggctttgtcgggatgcaaccatagttctggcgatccgcaatcagattcccatcaggatgtagtcagtatcttgttcgttggtggacgatattctgccggtccggtttccgggtgctgtgtgcctgtattcccgccttttcccagcgtttgatcatcctccgcctcctgtttcttccccctcctacggactttttggggtagaaaagaggtaaaagtggtggcagcagccctttttaccatataaaaaaagtgctgccaccaccctatgaaacgtcctgctcatggtgctttcagtggaaagagtgatagcagtggcagcagttttgcaaaactctgtggtggaggttttcgcgtaagatccggaatttcatctcaaaagataaggacgttttttaaaaagatcaagaactttcaaaaaaagataacggcctttttaaaaaagaacaagagcttttttaaaaacgtcttgatctttttaccgctgccggaaataccgggaactttgcgatcacactccatagaagtacaaaccctttacacacactttttacgataaaaagccagaaaacgccctactttatatcaagccggaatatcctacaaaaaaataatatatagctgacaacaagcatgttatacagaaatatgcttcaaaacgtagtgagggcatgagagattagtgagggcataagggagagcaactatttttaccacaactacacaaattattcatgatcaacatgttacatatacagtgagagcatgagggcataaacgctcccaacttttttgtggatttggactgataacgatgaataaaataatgtatcaagctattttataacgttacttacttattccaaactacaggatattttcaggcttgtccggatattacctcacctctttccgcccttcataatacttttgccgaaacggcgcggacggctgaaaaaataaatacttcctctactcaccgactggtagataaggtcggtcttatccacataaacatatccgttttcacggatttgactaaaagtctgtatgccgatagggtatttcataatttaattatttagcacataatattgtgaagataaaccaaacaaaccgatttcattcaatcctgattaaacatttttcatcgcggacgacttagcataataaaaagagtttccattttgaactgagatttcgaaagaaccaacagcacaaaaagaaacacccgaaagacatttactataaaccctccctcccttttcacttccttgcggaagcatcagcgtggtaaagtggtagaaaatcatcagaaacggatacggaaacgggtcagtttatccggataggtacgaagagagaaagtacacccatgttttatcaaaacttcacgaataaaaataagaccgataccctgtccgttaggcttggtggagaagaaaggactgaacagtttggtttccacctctttactgataccggcaccggtatcagcaatttccaacatcgtaggtgatacggaagtacggataaagatatctcctgtttccccgatactttcagccgcattcttgataatgttgactagtacttgctcaaacagagaagtatccatcatcacttcaggattctctttacataaatcaagatgcagcgtaatcttacggttacggcaaaccgtttccataaatgtcttgcaagtggctacgcggtcattcaagtccactgattgtaattgaggctcgggaatcttcaccacattggcaaaatttgtgataaaacggctcatgctgtagcaacgctctatgcagactttcatcacttcgcgcaagtcttccgtatcctccatacattccaaagcgccatccaccgtatcaagagtagaggtaatgcccgcagtcgtattattcacctcatgtgctatcatacggatcactttttcgtatgcctttttctctgctttcaccacctcggaagtcagactttccaccagaataaacggatgagagaagcctctgtcaacaaaagaaagccgggaacagcggtaaatcatggagtcgctcagacgaattgtttcagtagtatctttgggaatacgttctatttcttcggccaaaggggaagccaactcgcacagcaatcggcctctgacttcctctgccgaagaataatccaaaaaacgaagagctgcagcatttagcatggaaatatgtccgtccaaagtcagtatgacaactcccatgggagaagcgctgaccagcaggtcaagaaaatgattctgctcacgcaaccgaaggcgctcgtctttcaactgctccatcatgcggttgaaaaccaacacaatgcggtcggcttccttttgtccgacaggagtcagcctactgctgaaatcctgctcacgaagaagctccataccgttgccgatgatatcaagcggtttcacgactttgcgatagaaataaaccagaaacacaagactgaatgtaataactccctctcctatataaaacaacgcaccgcgttccttcaatgtaagaacgagcaggatagtccatactgctgtcaacagtaatgctaaaaagaagaacaagaatttcagtttcatattttatccggttccgtttttgctaatcattcacttgtatattgtatttctccaaacggcgataaagagcagcccggctgattcctaaggctacggcaacctgtgacatattattgttatacttctcaagcgtttgtagaatagtctgcttttctatctcctccaaggtcatgccttgcagattcgttgtcaccttctgttctataggatgctggtattgtgatttaaaatcatccgcagtcaatatttcctttccactgaccagcaaggtacgttccaccaaattctttaattcacggatattacccggataaggcaaacggcttaaataatccatcgcttcagaagtaaattccactttgggaagaccgttcgattcacattgtttgtcggcaaaatgacggaccaataacggaatatcctcacggcgttcgcgtaatgccggaagatgcaccgtaattaaattaatacgatagaacaaatcctcgcggaaggtgtgttcctgcaccatctgtcgtaaatcggcattcgtcgcactgaccacacggatatcgactttacggggacggctgtcgcccaagacttcaaaagtctgttcttgtaacacgcgaagcagtttcacctgacagcttaaatccaaatcgccaatctcatccaaaaaaatcgtacctttatcagccagttcaaaacgtcctaccctgtcggctgtggcatccgtaaacgcacctttcttatgaccgaacatttcactctcgaacaaagtatgagaaattcctcccaagttcactttcacaaaaggtttcttgctacggggactgttcaaatgtaccgcttcggctatcaactccttgcctgtaccactttcaccggtaatcaagaccgatgcgttggtacgcgctatccgcttgatcgtggccagcacatccatcagtgctttactctttccaatgatatggctacggtcaaagccgtcattatcttccaccggaacctctgctttcttatcttgtgaagtcagttccaaagccgtttctatccgttgcatcaacgccacgttgttccaaggcttggtaataaagtcaaatgcacctgcctgcatcccttgcacggcaagctggatacttccccatgctgtcatcaatataacgggaacatcgggccggaacactttgacctgtttcaaaagagtcaatccttcttcaccactggtggacagggtgaagttcatatccatcaagattaactggggcgcaaccgaacggactatttcaatagcctctttgggacccggtacggcctgcacatcatatttcgcccttttcagcataaagctcagagaagaacgaatggcactgtcatcgtctataattaatatcataatgctacaaatgtagaaattattattttaataagtacaaagacaaccccattttatattcaaacagaattgaatagtgaaaatcctattgtttgataatcttctcgaaatcggcatcaatattagtattggtattgaaatcccacaatgtcaagctgcgcaactggtaataatagtaccaataatagaacaactcattgatatgcttctgacgagcctcatctttctttgactgggaatcattcaaatccaatgtcgagattttaccgaccatgaaggtttccacattggtgctgtaacgtttctgggcaatcttgtccgcatcgtctgctatctgcaactgggcctgctggttattgaactgttctacaaggataaacagattctgattgaaattcatggtctcctgacgtagcttgctttcagtcacatcgcggttactttgagcaatctttacctgaccacgacgttttccccagtcaagaataggaattttaaaaccaacttctacaatctggttatctttcaaacggcggtatgcactattaaattcattgtctgttcctgtaaaacctacctgtgcatagagcttgatttcacgtaaattacctttcgccttagccacttcaaaatctgcttccaactggcggcgacgaatattgtgcgcaaatgaattattggcaagtgctttgtccaaaacatccggatagttcagcaatacagtcggaatcgtctcgggaacaaccggttccaattcctcatcttctcctaatgctagaaatgaacggagtttgaacatattacttttcaagttgctttcattttcagtcaacgtagaacgggcattcaatacattcagttccaattgcaacaaatcattttcactgatctgccccatactacgctttgccttagccacttcatacagtttatctgcattcttcagattctgtcgggcgatgcctacattttccttagccaacaacaaattgaaaaaatagttgatagtagtcatggttacctcttcggttgcagtaagaaatgcggctttagcttcagcgtatctcaccggttcgatgcggcggttccatttaattgtattcactccgaaaataggttgttccaaagtcaatgccacaggaacagacatatatcgttttgatttatctccatccagttgtttcaagaaatcaagagaggtattcaatgagagtttaccaccggtcaaccaaatattctgatcgatagaaacttcaccattcatttccatataattattacgtacaaatgtataagcaccgttatcctgctgataagaattatacttcttattatagctgggaatagtggcttcaaaattcatttccggaagcaaatccgcacggaaagtacgatattcccaataagcggttttcagctcgtttaaagctacggccgcatctacactttgcacacgggcaatagtaatggcttcctccaaagtgatggcacgtcgcttttcttgtggctgcgctccggcaaccaacgatatgccaaaggctaaaaatagagatattacttgttttttcattgcgttattattctttttatcaaaggtaaggcaaatggtatgccaaaaaactatttcactgttttataacaccttacgacaaaaatggagtgtccgaaatcggacactccattcatatacgaacactgctgatcatgtgacaatgaaataacattattcattatgcaacgcgtctgccggctcaatccccatcgctttccgggcggggaaataaatgccgagcaaaattattatccccaacaacagcatggccgacacaaaacaaagcaaaaaacgtccccaagcaggttccattaatgtatgcacagtaagatccgccatctgcatattcgcacaaacaaaaacagcgggaatggcagccgaaaccaagagaaggatgccctcaagtacataataaccaaatacattcatcctactgcaacctagtgccatacgcaaagctatctcacttcggtttttacgagtccgaaaccagaaagtacccagcatccctaaaaatatattgaaaacaaagaaaaggataacggcataggtagtattcagataattcaccgttccttgctctatatcgaaagcttccttcatatcgccatacgaatttatatcgtataagtaataagggccgatagataatttcccttgcatatcctgcataaaatgttcggtaaatcccggtatggaattggaagccacacgcaccgcaatgtgatgccaatgagtcagcggcggactgggaagataaataaaaggttcgtaacgctcgtactcatcggtcttatgagcaggaagtaccgccattaccttataattagtttccggttgcacactattcagaaaataaggattgaaacaagtctcccctactccattgcgtccgctaaacaaggaatcacttaacgtttcactcatcaacaccggcatggggtattcattcttgtcccaacgctccgcctcaaatgagcctgataatggctgcaaacgaaataccttgaaataagtagggctgacataacggatgaaacagcctaccacatgggtcgaatccgaatgcggagcatatccctcatacatattatttcccgtataaggtattgtcccataataaaaacaagcttcctccaccccttgatattgttggattaaatgatagatttgttccaaatattcagcagaatgactcattaatacagaatcattttgcaaagccggcttaatattcaattgaatatcaaaaacattctccgtgtcatatcctttagtctgacgggcagcagcctcataattataaaccagatcgatgctgtaccatagcaagataagaacaacaatcaattcaacccacacccatacattggcgtgcctctggttccacatttgtctgaataaactctttatcatttttctttcctcctattctcctttgatggtagtcgcaatattacgatgtgtgaccatccataccggaatcaataccgacaataaattaaaaacaacacatacgccgaaaaccaacacaaataaagcaggatgcaacaacaaacctccatccagactgatatctgataattctacctcgccgctaccaaacaaccatacacgtcccagccaaaccaacacacacgaaaacagatatcctaaaattccacccaaaaagaccgtaaacagattctctaaaaacaacctcaccataatggaaatacgtgatgcaccatacgccttgcgaactgcaatctctgtcacacgctcctgcattcgggcattggtcatacctgagatattaatagcaggaacaatcagcaagaccatcaataacatactgtaaaccaacggtgcactaatatcttttccacgaaaaaaggtatattccgtatgagtatagagttcgttcatctcgaaagcatattctgccgttgaactattcaaacgatcctgccgatgctgtacttcagtccgtacctctgcaggacgagtgtccggcagcagtttgagcaatcccagacggattcctcccaagccccctgtccaagtagcataatagtcttcattttccaatgagaaaggaacaaaagcatcagcgtatgctgtctggaaaatagcattgacatctttcaccacgcctaccactttagtcggaaaaaaattactttgatattcttttcctaccacatccgtcgtgccgaaaagctgcaaggccatacgctcggttaccacactgacacaccgacgggcatcatactcctcttgtgtgaaaggacgtcccgctataaattcataatcaaagaacttaaaccagttatcagccacaggccgcacaaaatagttgaatatctcattcgaagcggacaagttacaaggggtcttggaaacgccacgataccaagtaacctcttttacaccagggagctctgaaaacaatgcttcaaaagccttgcgtcccataccgctgttctggttggtatgatcctgcttacgataggtcattcccgaacctgtatacatcatatcgctccgatcactttccggagccatatccattgtacggaagtcataaatcatcactaccaccataacaaaagcgatagtgacagctgttcctataatactgattgtagcataaaaaggattctgccgtatcagattaaatgcttgtaataatagctgtttcattcgttttatctcttcattttatttattcttcatgtaatgcctcagccggttcgatactcatggcacgacgggcagggtatcctattccaatgacaatcattccagcaatcagaatgaaagtgcccagaattgtaatcgcaaaacgaccttccgtaaaaggcatacgtgtaacttccaccagttcggcatatcccaaattccacgctacgaccaatgcaggaatagcagataccaacaataaaaagactccttcccccatcagacgaccgcagattccccaacgggtagaacctaaagctatacgcaacgcaatttcgacacgccgatgctgtgtccggaaccagaaagttccgataatgcctagaaagatattcagcaataagaaaaatatgatacaaaattgcgtattcaactcattcaccgaatccgtttcataagcagtgcgtacatcactcaaaggagttatatccaaaagatatagattgcccacctgatattgacggtcggcatccactatcaaacggtctatgaatccatcattctgtccctcacgaacacgtaggcaaacttctatataaaccgtttcgcccaaggattccattacctcatctgtcaggtacacagcagcataacgggagccgtaatcatccggagctgtaaaatgatcataacggaccggctcggtaagagcagctatagaaaggtgctccgcctccggctcattccgccaaacaggcaccctacgccctaaaagttccttaccatgccaaggtgcatcctgataaacatcggcaatattcacagataagaccatgccggacggtgtcagtgcctcagcaaggctttcactatccgaaccgtctatattgcgataacggaatacattaaaatactccggagttatccatcgtttcaaactacgtaccgggactgtatccagataaaatgaaaaactgtttgcaccgtcattataaggtatacagttttgcgagaggctgactgcttccacatccggacgatgcgcaagcctgtttacaatttcatgcaaatcggcaacatcttctttcatagtacggccaggctgataagcagccgctttcgaagtcatccgctcaaaacgaagaacatacgtattttctatatcaaagcccatcggcaaattatagatgctcaatgtgacatataccacatccacaatataccataatatgacaaacaccacaaaaagttccatccacagaaacgcattgctgcggcgctcgttccatatctgtttcaataaattcctgttcatgatctaacgttggtttaaagcgtccgtaatattcatgcgcgatgccctccaggcaggaatgcacgctgacagcaaattcaagagcaggcagaaaatgaatgcggccaagaatatccagggactgaacaacatatctgccgaaagactggtttctcctatttgggcacggttctcgctattggaaaataagaaatcattcaataaaaaagtacatgcataactgaaaagcattcctactgctccggctatgagcgtcaataataagttttcataaaacacttgcctcaacaagacattggcagtagcaccaaatgccttcctcactcctatttccgacatgcgcttccgcatacgggacaaagtcatgctactcaaatttatagccggtaccagcaataaaataacaatcaccaacaggtagtgcaaataagcttccttcgcctgtaactctcttccccagtgacgaaagataaaagagaaacgatcatcgggttgtccacgataaaagatttcagaatcctgcaatccgtcattaaatttctgacgcagacgttccacctcttctctgatagcaggaaaatctttctccgaatgtgccagaatgaccacacgaaaagttcccatcgcattgtcataccaacacttcctggctatttcagttgaattgaaaggtatccaaatctgcgcatacgaagaaacagccagtttggatacatctttcacaacacccactaccgtataatcggccaagttaagttggactgtacgccccactgcttctaccgtaccaaataaattccgggccacagaagcgctaattacaaccttaggaagtccgctttcactatcggcagccgtaaacggctttccggcaataaaatcaaaagagaacactttccaaaaagtatcgtcagtttcaagattatccactgtcatcgtttttcccgcaggtacagaaatacgcatcctgcctcctgtagacactatagttaccgtttcaggaacagtaagcgccttaaaacactctttagccaccgtaagtgacatacagccgtttgatgaattatcactagtatctcctttctgatgaatagacatcgctttcatataaagagaacgtgaacggttcacctcaggcacacaatccgtaatgcgcacttccaacaccaaaacgatgaccatgatcatacaaatagccaatgccgttcctataatagagaccaagctgatgagcctattctcacggagttggaaaaaagcctgtttgaaatatagttttatcatgtttgtgctatgctctaaaatcttttaacaaaaaaagaaattactcattatgcaatgcttccgccggctgaactttcatagccttacgtgcaggaatccaaatgcctactacaatcatcaatgcaatcaaaataaaggagataagaactgttattatgaagcgtccaccttcaatagtagtaccattcatccaagcattcaattcactatttgccagattccaattgataaaaacagccggaatagtggctataaccaatagcagtaatccttccaccaactggcgtacaaagacactgtggtctgttcctcccaaagatttcatcaaagcaatctcaccacgtcgttgctgagtacgaaaccagaacgtgcccagcaatcctaaaaaaatattcaacaataaaaaaaccatacccaaaatatagctgcgcatggaattggtttgtgactgttgatagttacgacggatatcatcaaacgaacgcacttcggctataaacacattccccacccgatatagcttctcactatcagctttcaaacgggttataaaatctttatcctgatcttcttttacccgtacacacaattcaagtcccacatcataccaattctccggcaaaagtttcaccatactgtagctgttccatgcctgctcataatctgaataccggactacctccaacgatgctcccagcgtataggtttccgtcgtatctccaaacaaataaaactgttttcctaccaatggagtcaaatctcttccgtaacgtttcttgtataaattatcggaagccaaaaaattcttgggatggctaagcaactccgccaattgttcaggagtttccccacgagtaccatgatactggaaaacccggacaaaatcaggacttactaaacgtcgaatagtccatcccggcgactgaagtgtgtcatatctaacctccgtaccgctgttactcccattataaggataagaattctgaccaaaaccaaccgcctctatatccggacgatatttaagacgctcggcaagtcctttcacatcttcccgctgctgctcttttgtctgattaggaataaaatcaggacttttatcagtaaggcgtcccatttgtatcaaataacaatgggagatatcaaaaccacgtggctcatagtaaacagctgccttaacatacatataatcgacaatataccacataacaacgctcaccaacaacaattcggtaacaagccaaagattggaacgccactcattctttatttgtgtcaatagtttcttattcattctaactcttcttttaaattcttaatttttcatctattaatgtatctttcctcccaaagcattgactatgttagtacgcgatgcccgccatgcgggaataccgctactaagcaaattcaatacaaaacagaacaacaatgcatagaggaaagtagatggttgcaataaaattctggaatcaacagtaggcgcattcagagtaacactataaggttgtgcaaacaatatatcagtgccccaataagcgaataatatactaatgagcaatccgatagcccctgccaacaaagtgattacgagattttccatcacaatctgccccaccatctctatgcgggtacttccaaatgcacgacgcacacctatctcggctacacgctgacgcaaacggctttgcgtcatgctgctcaaatttatggcaggaaccaataatagaataataaagataatgacacgctcacgacgagccgcttttaaatccggttccaaattggcagcaaaagaaatcgattgggtttcctggtcataaggacggttgcgatctatcaatgtatacccttgatcagcaagtattgaattatactcattcatacggcgcttagcctcagcacgaatctcatcaaaatcctcacggtcatgcgccaacagagttacactcatcattcccatgtggttatcactccatgtgtcattagacaggttggtcgaagtgaaaggaatccatacttgcccgtaagccatatcggcaagagttgaaacatctttcactactcctactacacgataaggagcatgactcagcagaaattctttacctacagactgaatagaaccaaacaaggcacgtgatatgctctctgttataacagctacagggcgcccagctgtaaaagtagcttcatcatacggctttccatctgtaaactgaaaatcgaacacatgaaaaaatgtatcatctgtctcacgcacatcagctcctatcgcaggcgcaccaggtagggaaacaggagtggacaccgtcatgcaacaataaacagtaacagcctcaggagtcttcaacgatttgtatacttcacgtgcagtctgtacactcatcggaccattacttgtcccatttccccaatctttatgactgatactcatataatgtacatgtaaaaaacggttacgattggactcgggagaaaaaggagcgacctttacttgttgcatcatcactaccaacataataaggaaaatactcagcgcagtccccacaataccgataatactgataagcggatgttggcgtagttgtgccaaagcttgcttgtaatactgttttatcattttcgaattctattttattattttcttatacactttatatctatactagccaaagtcatgccaaagacacaaaaaactgaatataaacatattatctttattatacactgtccgaaaatgaacaccaacttcattttcgcacacgatttcatttcctgatatataaattaaagcagagatacaatgttctatatttccaaatagatcccaaatgtatctccgtttttcattaattccatcttttaataaaatgaatatctgatttactcaccatgcaatgcctcagctggctggatactcatggcctgccgtgccggaaaccaaatgctgatagcggcaatagcccaaagtaacagaaaagtaacgagccctcctatcaggaaacgtgtgaaactccattctacaggccatgtctctactaaatcagaaatacctaaattataagctacaaccaaagcaggaatataagcgatggttatcagtagaaagccttctcccattaaaagagtctgaagactgtgcggcgtagccccagcaaccagacggacggccagttcttcacgacgctgctgcgtacggaaccagaaagtacccaatatggccaaaaatgcattagctaaaaagaatccagcaatggccaaataagtataaagatcgctacgataatcagccagatgttcattccggtaataactcataggacgtatatccgccagatacagattacccacacgcagctgtttcttcatctctttccggaatgattccacaaagccaggacggtcggcatctgccttcacacgaataaatatatcatgataaggaatactgccatagcttatcttaaaatctccctgtcccaactgtacaatgcgataaacggctttactccaattggaatattcattatatttctgattctcgcatacggcggccacacgcaccgaatctggttcatccttgcgcatggaaaccccactatgaataaaccgaccggctagctccactccttttacagtcatattatttatgtccggattcaacagccgacaagctgtattttccgtcaccacaaaatcattggtatgtgatgcccgccgggacaactcttcaggcgaacattcatcagcccctctgacacgaaacacggtaaaataagaaggagtgacttcccgatacatcgcactggtcttcaatgtatcataagacatggttccactaccgtttttccatatataatggaaatgcatcaaagtataacatgcactttctactgccggatgatgttgcagccgattataaaattccaaatattcagctgtcacttcatcatcagaccgacttgctgtgtcacactccacgctttcattgggtaagacggccgcttgtacataatatacatgctcccaatcaaaccctaatgatttctgttggttcactaccacagcatacacataatccacagcataccacagtgaagtagcaatgacgaacattccagccatcagcaacagattggcacgaagattattctttataataattaataaatgaatcagcatagccttagagtttttgatttaacgaatcgacaatcggagtatgggcaacacgccaggcaggaatgtatgccgaaagcaaattaagcaccagacaaaaacaaagcgccacaaaaaatacaacaggactgaccatagaaacattcatggtagctgttgctccccaagcagtctgaagcaaccaatcactcatcagccacagacacagataagaaagtccaagtcccagcatcccaccgattaatgtcaatacaaagttctcgttcaaaacctgccacaccaactctccctgtgtagcgccaaaagatttacgaatacctaattcttccagccgacgacgcatacgggtatgtgtcaatccgcttagattaatggcgggaaccaataaaataacaataatcataatgccatatttccaatatgccgcatccagattttcatacgagttggcaaatttacgattcaactgagtacggaagttatccggttgccccatcagttgcaattctctctcacccagtgtcgtattaatctgtgccactccacgggccacctcattacggattttctcaaaatcatctgaacaatgcgccaagatagtaatgatatgatttccctgagtttctcctgcttccaccttattggctatcgcattcgaagaataaggtgcataaacctcactccatgcaaactcacaaaaacgatttacattctctactacaccacaaacagtataatcagtaaaattaatctgtacaggtttcccaatagcagcgtccacatctccataaagacgcctcgccacactttcaacaataacagctttctttattcccgactgaaagtcagcctgggtaaaaggttttcccgacaagtaatgaaattggtatatcttccaaaaatcagcatctgtcagtaacaacggtgtattgacctcttcatcagctcctggagtactgactaatacttcaccggcttcataagtaacgcatacagcttcgggagttttcaacggataaaagacttctttagccatccacaatgaaggtcgggaatgacctgcgctgttaggttcttttttgtcatataccgtacgctcccatttgacgtaaagcgagcgtgaacgatttacttcaggagcatagtccgccgttttcgcttgatagacaattagaataaccattatcaaagcaatggcgagggcagttcccaatatagtaattgcacttagtaacggttggttacgcaattgataaattacttgtcctattgttttttttatcattatagtaccttttcattaatggtccgtagaaaaaatgaagtagcctccagttattgcacctgacggccatcaaagaaacggatagttcttgaagtctgtttggcttgttcttcattatgggttaccatcacaatggtacgtccatcttctttattcaatttatgcaacaactccattacttcagcacccatttttgagtccaaatttccggtaggctcatcggcaaggataatttcgggattgcccacaatagcacgggctatcgccacacgctgacactgaccaccggaaagctgtgtgggcatgtggcgcatacgatggcttaaaccgacacgctccaacacttcttttgccaaacgggtacgctccttggcagccatctttctatagagcaaaggcaattctacattgtcaatcacattcagcgaattaatcaggtggaatgactggaacacaaatcccaaagtcttattacgaaaagcagccagttctttatctttcatactttctacagaagtaccgtttatttcaatctttccactgctgggagcatccaataaccccataatattcaacaaggtagacttaccgcaaccggaaggccccataatactaacaaattcgcctttaatcacatccaaatttacattttccagtgctaatgtttcaatctcattggtacggtagattttattgataccggttaatttaatcattgccataatttttcttatttaaattgttaatcttatacactttttatttttatgaatcaaaagatataccaaagcaataaacatttaattttcaacagattattatttaatatattgtccgataacggacagtatgatcgtttttgtcagtcgtattcatcccacaacacatctaccggactaatacaactgatgctgtataccggaataagaatgccaacaagcattatgaataatataaaaaagtaaacaatcaaaaaaacgacatagcctaagaacaaattaaattatgttcgggaaatgagtgaaaaggaagaaaagacacttcatttcccgtaacaatcaatgtattaattaagagagagttttatcttgttgtttatgtcatagctgcttcttatttcaacttcaacttattcttgtttttgtaactgctcatatcgctgacaaccaccttgtcacccggtttcaatcccgatatgacttccacatattcaaaattactgtcacccaattgaactttacgcttcactacttcatccttactatcctgaacaaataattcatattcaccgcgaccgacataataagaagcattcgccaatcttaaaaccccttctttcacggcattcattacatatacatccgtcttcaagccggaacgcaatcgcttgttattatcttcattcagttgtacaatgaacgaaatcaccccattcttactcaacggtgtcacactacttaccgttccttccagtttctcattgccaatcttgactatggcacgtccacctgctgccacacggtcaccgtatgtatcagctatttcaccttccactttaaagtggctcaaatcagaaatgatagctacttgactaccttccgccacctgcgcacctacctgattattaatataggtaagaatcgctttacgcggtgaacgaatttgagcgtcatccaatgtacgtttcatttcagcaagactctttgagaaaatattgaattccaattccttcactttcaaatcagcctcttttactttcgattcatttgcgtattgctgacggagctgttccaattccagttttcctgtattgaagttcaattcagcctgacgaaccttgtccgttgttccagaacccaagctatccaaataacgttcgttgcgaagttctacctccatacggttcaatttcatggcagaaattttcacttgcattgataaatcgctcagatacgtattattattcaccttcaactgctctaactgataacgtttcatctgttcttcatccagcaatttcttgtattcggtttccgtactctgcaaatcaagtttcaaaatcggcgtacctacatccacgctgtctcctcccttacggtaaacttccacgatacgagtattaataggtgaattgataatctcttcaaaagccgggacaaccttaccggaagcactgacacttacttcaatagttccattgtctacttctgaaaacaccaaatctttcttattgacgctacttcgcataaacgaaatcaatacagctatacataccactgccgccacacctattgcaccatatttaatgaacttctttttgcgttccttatcacgcacttctttagggatttctctgtccataacttattgtaattttattattgtcatttttgtactaaagaataaacaacatccgtgccaagaaagcaacttattgataatcaataacaaacaaaacgtacagggtgtccgaaatcggacaccctgtacgtttttaaacatcagttaccgtactataatgactaacgcaaacgcaatatatcacctactttaggagaagaatcttccggtttcatcttattcatcttatataaattcttcagacgaataccatacttttgggaaatagaatacatagattctccctcacggacaacatgaactatgtgttccttatccgcacgacgatgctttttatccaaataaataatatcacctggtttcaatacatatcctttataaagatcattgtatttcctcaacttacgttgactgatatcaaattctttagaaagttttttaaatgtatcccccgggcgtaccacaatataaagtaaatcattagctaaataaggctgatgcgggtttgggaattccttcatccactttataccatccttggtatcatacttatgtaattcatataattcaatgatatcaattaaacgatacgcatagcgagggtcagtagcatatcccgccttcttcagcccatgtgcccatcctttataatcggtgatttttaatttaaaaagagatgcataacgtgaacgtccttttaaaaatttagaatgatcttcatatgactcacgagggtgcttataggcacgaaaacattcattacgggcatcatcatcatgccgtacagtacgaccagtccagtcaccaccacattttataccaaaatgattattggatttacgagccagcgtactttttcccgcccctgattccaataatccttgagccaaagtgatgctggcaggaatacgataccgtttcatctcatcgacagcaagatctttatacttatgaatatattcctcatactgccggttacgggtttgcgcttgcactgtaaaattacatagacaacaaagcaacccgattaatataaatttcaacgtatgtttcatcatataaaactgtttcaaaatcgctactatactttatccgttatatatagttgcaaacttaccatttttatccagctgtatgcaatctttttaaattaattacgaatttcattcgaattccaaaagtccaaagaaatccggacgatgaaaatccggcttctctatttttataggactccatgataagaaatgaggcttttgcaattcatctccacatttataaaaattagctcgtacaaccattccatccaacttggtaatggtatgcttaaaaaataccttatacggaatctgcaaagcaacctcccaagtacattctcctatcttttcttcaaaagtttctctgcccaaactagcccaacgcttcacctgatctgttatttcaagaggagccatttctcgattactacgctccgaacctgctgctaaaagaatcgtagcgatacagttacattccaaattgtaataaacgccatctctcgcaggaatagagaaaaattccacacaggaatccgtccagacactaccgttatcttcaccgtatttggcacgaacactatcttctactactttataatgaactaatatagcatcatttgtataggctatacgaaaagagacttgaggttgataaggatattctttccagttcactatattaataggataatacattatgttctcatgatcaaataaggtcggtatttgttgtgcatcctgaactttgccacttaatttctttactttcatcatattatttttattaattaaatagctactgttagcttcacaaaaatatatacttccaatgagaaaacaaaatagtggctaccataaacagcagccactaaaagaataaagccataaagacaatgaaagtactattttttccccatttcacccatatttacttcttcacatcgccctgtgacatatgtcttcttccatcatgctgctttttcattccttgtctttttttcatctctttacgaaatttatcaccattgtgtttctccatattatacattttctgaatttgtttaggagaaagaaatttccgaaactcattataatattcctcacgaatatccagtatctttctactctgcgcgaaacgtgccttaatagcctgctccacttcagcatctgtagggaccggtttggggatctgtttatcggcggccgttctatttgcaacatttcgacaaactcccatatgacgagtagcctgcatttcttccatgtattgtttatacaccggaataaatttagtagccgttgcgtcatccaatgccaatccttttataatttgattgcactgtatttccagcatctgttctttattaaactgccttctttcagatttagtttctttcttttcttgggcaaaaagtgttacctgacttcccataacaatggctgccaacaccattaaaaaaaattttgttctcatcatttttttgtttttagtgattaatcaatttataaatatatcattttcagacaattccacccattctgctaattcctcatcagacatagattctatataacgatccaaagtatctgaataagaagagtctaaatccgtagaaacaataagtgaatgagaaggcaactcctctgccacaggttgagatatcggaaagaaaagaactcccaacatgacagccgcaatagctaaagtagccccaataatcaattttattctattctgcctattaaacctctcagcctgggtacgctccaatacttgtttttgcatttttccgaaaaagccatcaggggtacgataaggcatccgcttcccaatattcttaaaatcaaactccttttccatcctatctttaattatttatcatgtactcttttatcttctcttttgcataatgataattcactttcaacgtatccaccttcgtgtccgtaatcctgctaatttcttcatattccagttcatcataataacgaagattgaaaactacccgctgtttttcaggaagcatcaaaatagcctgctgaaatttcaccgccatttcgttctcataatccacataatctgacgccatcaacttattcattaactcttcctgaacttcttccgccgaaacagcttgttctttacgcatattcagaaaacggagacactcattggtcgctatccgataaatccatgttcccaatgaactttcctccctaaactgaggaagatggcgaaagacgcgaataaagacttcctgcaaaatatcctctgcatcctcatgtgatacaaccaatctccggatatgccaatatatgggctgttgaaaaaaatctatcaacaatttaaatccccgttccgggtcggaagcccatacttccctaattttatcttcgtttatcatctattcgtcaaaagtttataggttagaaccacccgaaaacaagaagttaaaagtgaaaataaagtttttacattaattatagatgaagttaaaataatcaatcacatttccaacaagagaaaaatacaaccaatcttccagaatatgaatttaaagatttcaaactcaatcttcctaacaataaatttcagttcttagaagaattaccatataaacagtagggaaatccctaaaaataaatagggaaaaagatagaagaatataccttttcccaacttatctttgttacaaacaaaaaaacaaaaaaatgagaagattgaaacaaacattattagcgttaaccatttgtactttagtcatcagttgcggtttgactactagtagcactattatgaaagtacagagagggatgtcccaagaagaagtcagccatttacttggaaaacccgatttccgtagattcgacaacggctcggaacaatgggaatacaccaagaccaatatgtccacagctgcaaacacggtaattattatcgattttgtagacggaatggtaacaaacatggattcttttgagcccaacattactccgcctccagttgcagtgtgtccgccaaatgaaataattacggtagttccacccagccaccctgatcattttggcccgcacagaccaaaacacaaagctatgaatccacatgattttgaaaacctctataaaaaagtaaaaaacaaagcatttaaggacgaccaaatggaattattatctgtaggagttgtaaacaactacttcacctgtaaacaaactgcccgactcatgtccatatttacatgggacgatgaaaaaatgaaagtattaagaatggtttccaaccgcattgtagaccgtgaaaatggaaaagaaatcatcaagacactggattctttatttaaacaagatgatgcacgtaaaatattgggaatcactgaccgatggtaattcaacctaaacaacacacaaaaacataaatatatgagaaaatttaaacaattattattgcttgttatcagtataacacttgtcggctgtcataccacaggaagtatcaagcagaaagcatggaaggtacagcagggaatgacaacagaagaaataggccaacttcttggaaaacccgatttccgacgtttcgatggttctttggaacaatgggaatatcagagcggaggaattgcaacgtcttgcaaatttctaattatcgaatttagaaacggaaaggtaacaggcatggattcctacaatgaaatagctaaagaaacttcagtaggagacctatattccagcaaaatatccctccataccgttggttcaatagacgataacgaatttgaaaagatatacaatgaaacaaaaaattccgtgttcaaagattcaactctggaaaaggccattataaataaaaaattaagttgcgcacaatgccttaaacttatgtcactttatacttttgataatgacaagttaaaaatgttacaagtattgaaagaccatatagctgacacaacaaattacgataatattgtcaactcactagatttcatttcaagtaaaaacaaggccaaagagatattaggaataccctaatacagtaaaagcaaacgtacctgttgcaataaacctaaaaaatattgcaacaggcacatctgctttacctcaatcttctattctgacagctgtgccgcttgcggttaccatcagcatactaccactgtcccccacagtttcataatccaaatccaccccaactacagcattagctcccaataaagcagcctgatcctgcatttctcgtaacgcggtatctttagcctgtcgaagtacttcttcataagaaccggaacgaccgcctacaatgtcacgaatactagcaaaaaaatcacgaaacagattagcgccgataatagtttcacctgttacaatgccataatatttggttatacgttttccttcgatagtaggtgttgttgttgctaacataatctttctcttttttaattatatattcattagacgcacaaataaaagaaaaagttgcaactttctccttttttatcggtaaccatattattcttttcacattcaactctgacaagcaataagaaagtaaataaattaaaaaccagattttagaaaagaaacattgggagattaaaaacaaaacattacatttgcaggaaaacaaagaggaacgtatcatgaaacaaatcaaactggaaataaacatagaggcttgccattataacgaactaacagagaaggaccgcaaactgatagacgctgcgtgtgaagcaacgaaaagaagctatgctccttactcacattttgctgttggagccgccgcactgttggaaaatgatatcgttattaccggaaccaatcaagaaaatgcagcctacccatctggtctttgtgcagaacgtaccactttgttttacgccaattctcaatatccggatcaagcagtaaaaacacttgccattgctgcccgcacagaaaatgattttcttgacacacctattcctccttgcggtgcctgtcggcaagtattattagaaactgaaaaacgatatggaaaacccatgcggatactgctttatagtaagactgatatttatatattagaaaacgtaagtggacttttacctttatcgtttgatggaaattatctgaaatgatacctaccatccgtctgcacagccaacagttaataaatccagttttaaataatccgaaagacctcgtatcatggatgggaagcattcaagcgcaagattacactatgtccaaatgagctattggtatccggctagaggcaggaaatctgcaaacagtcaatgaggcactggcaaaaggatatatattgcgcattcacgtcatgcgtcctactcggcattatgtagctgctgaagatatacgctggacactgaaactttcatcccgacgcatcattactgccaatcactcttttgccaagtccagagagcaagacatttcagttgacatttacaacaaagcaaaccgactattagaaaatcaaaagagaattactttccctagcggagaaagaatacctcactttttcctccgaacagtaagtaatttgtaaatggattatttctgcgtcatcacatttcaaaaataattcattacatttacattattcagtattgcaatataaaactctcagctactttcaagaaacgttcatgacctttttcattcaaatgtgcagtatctgtattatttttgctgttctgaaaatatatttttctaaaatgatcattatttgcataaattcctccttttcgggcgctgtcaaaaataggaatactataatttccacaaacctcaatcatagcatccaccactttctcagcatcacttcccgcaaagtttttacagttccatcgggtaaagaaaaaaatcttagctgtgggatacttttcaataagcccttcacacagcattgccagcctctctttaaatacatcaataccgccaattgaatccaatttaaaaccatcattgtgcccacccacaacaataacataatccaaatcatccggcatttccttatatcttacatacatcgcttccccccaacgcgggctactataagcaatgctgctgccgttcttgccataatttaaatattccataccatgcttctcggcaaatttataatgccaggtattcttaacaggttccttatgattcttcacataactatctccaataattcccaaacgttttcctttcaattcatcagtcctgacgataactcctttaataatttgttccaactgcttatatacctgttgtcccaaatactctgccgaatgagccgtaaaatgaagtctgtcatttagcaattctgcgcctgacatatctatcaggtgcatgttcggatcttcagcagccaattgcttcatcgcattctccacttctctgctgaaatatttattacttcgggcaacagtaccaaaaataaaaggcaaacgagaataatcctttccggttttttctgtcagatgcatacgcacataagccaccattgtcttcaagttacggtaataatctttacttttagcataatcactttccccctgatgccaaagaaatgcatctatctgatagccatccttcagccgggaaagagttttgtctatacacatgtctatctcttgaatgaaagaaagcaacaaagaatttcctccatcagaagttggcttagcctgtgccagccattcaggagccgcagaccaaaaacgtcccttggaagcattataatcaggtgcaatggaagttccgccaacagcccatttcaccacataaaatttctcctgcaacaactgctccaaccaataatatgtcactgcatcaaaagcccacatattattttttccgctacgtttggcacgaggccagaaaggaataaattctcctttcccgtcattctgagctatctgacaataacggtaggcaccttcggtatacgtcagtgtgtccgtagccaatgctttaatatatgccggcaaatcttcattaggagttcgtccatcggtattagactgtccggcagttataatcacatgtacaggattggaagccatcgtattcaagctaacagctgcaaaaatcaaaatcaaaatcaaaattaagtttttcataagtatcatttcatgtttttaatggacacaaaaataatcctaattctaatataacgacatggattatcgtccattatcatagatttttgaactcattatgattcatacagaatgagaattgcggctaaaccataaaaaaagagccacaggaacaatggctcccaatgactctttctttttcagctcatatttataatttaattatctccatacatacgcgcacgcatttctttaatatgatcagaagtgatgtattcatcatattccatcatcttgtcaatgataccattcggggtcaattcaataatacggttcgccaccgtttcaataaattcgtggtcgtgggaagagaacagcacatttcccttataagtcttcagattattattgaaagcctgaattgattccaagtccaaatggttagttggagtatccaaaatcagacagttcgcattacgcaactgcatacgggcaatcatacaacgcatcttctcacctccggaaagcacattcactttcttcaatacttcctctccggaaaacaacatacgccccaagaaacctttcatatagacttcgttaccttcgccaaactggctcagccaatctaccaaattcaaatcactttcaaagaaatccgtattatccaaaggcaaataagccgtagtaatagtaacgccccacgcgaatttaccagcctgcggagtacgatttccattgattatttcaaaaaaagcagtcatggcacgcggatcacggctcaaaaagacaatcttatctcctttttctacattaaaattcacatcattgaacaataccataccgtcttcagtttccgcacgcaagccggatacttccaaaatctgattacccggttcacgatccggagtaaagatgataccgggatatttacgggacgacggcttaatttcatctacattcagtttctccaacatcttctttcggctggttgtctgcttgctcttagccacattggcactaaaacgacggataaattcttccaactctttcttcttctcttcagctttagccttctggttctgctgctggcgaagtgccaactgacttgattcataccagaagctatagttaccggcaaacatattcactttaccgaaatcaatatctacagtatgagtacaaacagaatccaaaaagtgacggtcatgacttaccaccaacaccgtgtgttcgaaattagaaagatattcctccagccaagtcaccgtatccatatccaaatcattggtaggttcatccaacaacaagttatcaggattaccgtaaagtgcctgtgccaacatgacacgcaccttttccttaccgctcagttcccccatcaacatataatgcttgtcttcctttatgcccaacccactcaacaaagaagctgcatcactctcggcattccaaccatccagttcggcaaacttctcttccagttcagaaactttcaagccatcttcatctgtaaaatcagttttcgcatacagttcttcacgctgtttcataatgttccacaacacagtatgtcccatcataaccgtatccatgactgtatattcatcccacttaaagtgatcctggctcaatacagacagacgttcgcccggtcctaataccactgaacccttagtcggttccagctcacctgaaattgctttcaagaaagtagattttccggcgccgttcgcaccgataaccccgtaaatattaccattggtgaacttcatatttacgtcattatacaacactcttttaccaaattgaatggccaagttcgaaactgtaatcatcctaatataccttatttatataattattctattttgaaattgcaaaggtaggtattttaattcagaaaagtatgccagtgtggcagaaattccgtacttttgcaaaattatcactctaaggaaacaactaggcacgaaatttgttagcagtaaattaacctaaaagacctgactgttatgagtaaaaataagaaaaacaaaaagtttaataagaatatgaacccaacagagaagaaccaacctcaagacgaggaagttttgaaaaatcaggaagcggcagaagctgccattgatgaagaaactcagaaagaagcaacagaagaactgaacgctgaagagaaggtgaataaggaattggcggaagctcagaaaacaatagaagagctgcatgacaaatacctgcgtctttcagccgaatttgacaattaccgtaaacgcaccatgaaagagaaggccgaattgattaagaatggtggagaaaaggccattactgccattctccctattttggacgacttggagcgtgctgtaaaaacttcagaaacttcggatgatgtaaaagcaatgcgtgaaggaattgagttgatctacaacaaattcctgaaagtattgaaccaggaaggacttcagaaaatagagactgacggtgagaactttgataccgattatcacgaagcaattgcattagttccagctccttctgaagagaagaaagggaaaatattggactgtgtacaaaccggttataagctgaatgacaaagtaatacgccacgccaaagtagttgtggctcaataaaacagtatcataaaacgacatggcaaaaagagactattacgaagttctggaggtggacaaaacagccacccttgatgttataaaaaaagcataccgcaaaaaagcaatacaatatcatccggacaagaatccgggggataaagaagcggaagaaaaattcaaggaagcagccgaagcttatgatgtgttgagcaacccggataaacgcgcccgttacgatcaatttggacatgcaggaatgagtggagccgccggtggcggttttgaaggattcggacaaggtatgtccatggatgacattttctctatgttcggtgacatcttcggtggacatggaggaggtttcggaggctttggaggtttcggcggtggcggacgttccgcacaacgcaagttccgtggttcagacctccgtgtaaaagtaaaactgaacttaaaagaaatttctacgggagtagaaaagaaattcaaactgaaaaagtacgtaacatgtgaccattgccatggttcaggagccgaaggagaaggaggaacggaaacgtgtcccacttgtcatggaacaggaagtatcacccgcacccaacaaagcatttttggaatggtacaatcacaaagcgtatgtccacaatgtaacggagaagggaaaatcattaagaacaaatgtaaagcttgtgcaggagaaggtattgtatacggagaagaagtcgtggaagtgaaaattcctgccggtgtggctgaaggaatgcaactttctgtcaatggaaaaggaaatgcgggcaaacataacggtgttcccggtgatttacttgttgtcatagaagaagaatcccatccagacctaatacgcgatgaaaatgatttgatttacaatctgttactaagcgttccgactgctgctttaggaggtactgtagaaataccaactattgatagcaaagtaaaagtaaaaattgaaccaggcacccaaccaggtaaggtcttacgcctaagaggtaaaggattgcccaacgtcaatagttatggttacagtaacggtacaggtgatttattagtcaatataagcgtatatattccagaaacattgaataaagatgaaaaacaagcactagagaaaatgcaagaatcggataacttcaaaccgaatacaagcattaaagaaaaaatattcaagaagttcaaaaacttcttcgattaatttttatactacaaagtgtcacagaaagaatactaggttttatatctgcctggcattcttttgtgacactttgcggtaaataaaaacatttgccatgaattacgaagaaacattggattatttatataatagtgccccattattccaacatataggaaaagatgcatacaaagcaggattagagaatacttatcttttagacgagtatttcaaccatcctcatcgccaattccgaaccattcatatagccgggaccaatggaaaaggctcttgttcacatactttagccgccattttacaatcagccggatacaagacaggactttacacttctccacatctgatagattttcgtgaacgaatacgtgtcaacggaattcctgtatccaaagaatatgtcatagactttgtagaaaaacaccgtgtcttttttgaacctctgcatccttctttctttgaactgactaccgcaatggctttccactattttgcccagagccaaatagatgtagccattatagaagtcggcctgggaggacgaatagattgtacaaatatcatccgtccggatctatgtgtcataactaatatcagtttcgaccatatacaatttttaggtaatacattagccaaaatagccacagagaaggccggaatcatcaaagaaaagactccggtagttattggtgaaaccacacctgaaaccaaacctatatttacaactcgtgctaaagaagtaaacgctcctatctactttgcagaagaagaacagttattacactcctccagtataaatgaaaaaggtaaacgaatatatcaaacaaccgactacctcaatctggaaggcgagctggaaggactttgccaacttaaaaacaccaatacgcttttatctgccatccgcctattaaaacaagcaggttatcagcttaccgaaagtaatatacgtaaagggttctcacaagtatgtgaactcaccggtctgatgggaagatggcaaaaattagaaagtgaaccgactttaatatgtgatacaggacataatgtaggaggaatttcgtatatcatagaacaattaaaacatcagaaatatgaacgattacacattgtaataggtatggtaaacgacaaggatatcagtggagtattgtccatgcttcctaaaaatgccacatattattttaccaaagccagtgtaaaacgcgctttatccgaaaaagaattacaaagcttagcgatgcaatccaggctgcacggagatgcttatcctgatgtagaaaccgctgtagcagccgctaaagaaaaagctaacaaaaatgactttatttttgttggaggaagcagctttatcgttgcggatttattaaaatttcacgtttagtccgttcacttttatagaaaaagtttgggaataccgaagaaaatctttttatttgcattagttttatacatacaataaaaagattttcaataacatgataaacacatctacttccgatgagaatttatgtggcctgaaacgggccgattttcagacaacagtgaacgggaaacaaacagacctcttcattctgaaaaatgaaaacggagctgaaatagctgttaccaactatggtggagcagtattagctattatggttccggacaaaaacggtaaatatgccaatgtcattcaaggacatgatagtataacccatgtaatcaatagccacgaacctttcctcagtactcttatcggtcgttacggaaaccgtatagcaggaggcaaattcattttagaagggaaagaatattcactgactatcaacaatggtcccaactcgctgcatggcggtcctaccggatttcatacccgcatttgggatgcagaacaggaaactccacaaagtttgaaattgcattatttatctgctgatggcgaagaaggatttccgggaaatttggatattcacgtaacgtacactttaagtaatcaaaatgaattcatcattacttaccacgctacaacagacaaaacaacattggtaaacctcactcaccatggttttttcagcctatcaggcattgccaatcctacggcaaccgttgataacaacatcgtaaccattaatgctgatttttatactccgatagataatgtatcaatccctacaggcgaaattgccaaagtagaaggtactcctatggattttcgtactcctcaaagagtagacagtagaatcaatgccccattcgaacagctaaaattcggtgccggctatgaccactgctatgtattaaacaaacgtgaagcaggcacactgagttttgcagcaaaatgtgtggagcccgaaagcggtcgtagcatggaagtatacactacagagcccggcgtacaagtttatacttcaaactggcataatggtttcgaaggtgctcatggagcaactttcccagcaagaagtgccatctgttttgaagcacaacattttcctgatacacccaataaaggccatttcccttcttgtgttctacatccgggggaaacttacagtcaagtaaccatctacaaattcggtgtagaaaaataattttatgaaataacctaatttataaacttataattttttcaagaccatgaatcaacaaaaacagaacggtaatatcatcgctatcattacaatgttcttccttttcgcgatgatttccttcgttactaatcttgctgcgcctttcggcacaatatggaaaaaccaatatgcaggtgccaataccttgggtatgatgggaaatatgatgaatttccttgcatatctgtttatggggattccttcaggtaatatgcttgtaaaaatcggatataaaaaaacagccctcattgccatggcagtaggtttcatcggtttgtttatccaatatatttccagtttgttcggtgcagatatagacgtattcaatttaggagaatatgccattaaaatgaattttattatctacctgcttggtgccttcgtctgtggtttttgtgtatgtatgctgaacacagtagttaacccgatgctaaatcttttaggtggtggtggtaacaaaggtaaccaattaatccaagccggtggtgctctaaactcattgtcgggtactttgactccgcttttcgtaggtgccttgattggttctgtcacccctcaaacagctatgtcagatgtagctcctctgcttttcatcgcaatgggtgtattcgtatcagcgtttatcgctctttcattcatcgctattccagagccccatctaagaaaagcaggtcatgaaaaagagaaattctctcatagtccttggaattttcgccatactgtattaggtgtaatcggtatctttgtatatgtaggcattgaaatcggtattccaggcacattaaatttctaccttgccgacccaacggaaaaaggtgcgggcctgcttgccaacggtgccgctatcggtggtgctattgctgccatctattggttgctcatgttagtgggacgttctgcaagtagtgtcatcagcggtaaagtagctacacgcacacaattgattgttgtttccgcaacagctatctgttttatattaatcgcaatcttcactccaaaagaaatcactgtctctatgccgggatatagtgtagaaaatggattcgaaatggcctctgtacctgtcagtgccctatttttggtactttgtggtttatgtacgtccattatgtggggaggtatcttcaacctcgctgtagagggtttaggcaaatataccgcacaagcttcaggtatttttatgatgatggttgtcggtggcggtatcttcccattattgcagcaattcatttctgacgctgtgggatatatggccagctattggttaattatcgctttgcttgcttatctgttgttctatggtttgataggatgcaagaacgtaaacaaagacattcctgtagaataattataaaaacatatagtattaactttaaactattaatatcatggatatagaatacgtaagaagtcgcttcatcaaacattttgatggtacaacaggttcagtatatgcatcacccggacgtattaaccttattggagaacataccgactataacggtggttttgtatttcccggagcagtagataaaggtatgattgctgaaatcaaacctaatggtaccaataaggtacgtgcttattctattgatttaaaagactatgtagagttcggtttgaacgaagaagatgctcctaaagccagttgggcaagatatattttcggcgtttgccgtgaaatgatcaaacgtggtgtagatgtgaaaggttttgacactgcttttgcgggtgacgtacctttgggtgcaggtatgtcttcatctgctgcattggaaagtacatacgctttcgctatcaacgaacttttcggcgacaacaaaatagataaatttgaattagccaaggtaggtcaggcaacagaacataattattgtggtgtaaattgcggtattatggatcaatttgcatctgtatttggaaaagaaggtagtttgatccgtttggattgtcgttcattagaatatcaatatttccctttcaaaccggaaggttaccgtttagtattagttgactcagtagtcaaacacgaattggcttcttctgcatacaataagcgtcgtcaaagttgtgaagctgccgtatctgccattcagaaaaaacatcctcatgtagaatttttacgtgattgtacaatggaaatgttgcaggaagcaaaagccgagatcagtgaagaagactatatgcgtgcagaatacgtcattgaagaaatccaacgtgtactcgatgtttgcgacgctttggaaagaggtgattacgaaaccgtaggacagaagatgtatgaaactcactatggcatgagtaaattgtatgaagtaagctgtgaggaacttgatttcttgaatgatgttgctttcgactgcggtgttaccggttcacgtgtaatgggtggaggtttcggtggatgtacaatcaacctagttaaaaatgaactatacgaaacattcatcaccactgccaaagaaagattcaaagaaaaattcggaagaagtccaaaagtttacgatgtagtcatcagtgacggttctcgcaagctggtataaaaaatatctcaaattcgctaacatatgaaaaaaccgctttgaatccaaagcggtttttttcttctttatgctataaaagtgtaggaaatacacttttatgttgcacaacatactcttttcatatccaatgtattagtaatagtgttacttttacacccaaaatcatatactctattactaattagtacttttatatcatgaaaagcatgaaaaaaacctttctgggaaccggtatcgcactgacattgttaagtgcttgcgctcccaaacaatctcaagaagcacttacaaagtccggattagcccccactaattatgaaacaatagtggatggcgtaaaacctgttaaactgtatacgctaaaaaatgcagccggaatggaagtatgcgtaaccaattttggcggacgtattgtatctatcatggtccctgacaaaaacggaaatctaaaagacgtagtgctgggttttgacagcattgctgactaccaaaatattcccagcgacttcggtgcttctatcggacgctatgccaaccgtattaataaaggagtcatcgtaatagatggagaaaccattcaactgccccaaaataattttggccactgcctgcatggaggtcctaaaggatggcaataccaagtttatgaagcaaaccaattaaacgacagtactatgacactaactatgaagtcaccagatggagatgccaattttccgggaaatgtaaccgctactgttacttatgcactgacaagagacaatgccatcgacataaactacaaagcgacaactgacaaaaagactgttatcaatatgactaaccactcttatttcaacttgagtggaaaccctgccaatccagccaccgaccatattctttatgtaaatgcagacagcatcactcccgttgacagcacattcatgaccactggagaaatgatagcagtaacagaaactccatttgatttcaatactcctaaaactattgcccccgatgtgactaattttgaaaacgaacaaataaaattcggcaacgggttcgaccacaattgggtacttaacacgaaaggtgatatcaaccaactggctgccaaactgaccagccccactagtggtatcactttggaaatatatactaatgaaccgggaatacaagtctatacaggcaactttttggatggaactgtaaaagggaaaaagggaattacttatccgcaacgcgcgtctgtttgtctggaaacacagcactatcccgacagccccaacaaatcacaatggccttctgtaatcctggaaccgggacagacctatcacagccaatgtatctttaaattcggtgttgaaaaataattgttaaactttaaatatttaatatcatgaattggaattcacatgaattcatctggctggactggacaatactggcagtcggcattgtagctgtgatatgggcggtatggcgctctgtacaaaaagacaaacgctcgcaacaaggagcaagcagtgaagattatctatttggtaaaggtgagccatggtacatcattggtgctgctatctttgcagccaatatcggttcggaacatctggtaggtttggcaggaaccggtgccaaatccggagtaggtatggcacactgggaaatgcaaggttggatgattcttcttctaggatggctttttgttccattctaccaactattaaacaataaaatgggcaaaatcattaccatgcccgatttccttaaataccgttataccccacgtaccggttcatggctttctatcatcacattgatagcctacattcttactaaagttagtgtaaccgcctataccggaggtatctttttggaatttttacttggacttcctttttggtatggggcaatcggacttattgtcttgaccggcatcttcaccgtactgagtggaatgaaaggagtaatgaccctctcagctattcaaacccctattttaatcattggttctttcttggttcttttcctgggactgtcagccttgggagacggtaatattgctacaggatggacagaaatgatggatcatgcgcgtagcgccatgaatataggagcagacggacacgcttatggtgccaaccatatgtttcactggactgaagcagacccgatgtatcaagattatcctggattctgggtatttatcggagcttctatcatcggtttctggtattggtgtaccgaccagcatatcgtacagcgtgtacttggacaacgtaaaggcgaagataatgatgtagtaatgaagcgtgcccgtagaggtactattgcagccggttattttaaaatcctgcctgtcttcatgtttcttattccggggatggtagctgccgccttagctgcaaaaggtgaatttgatatgtcaaatacagatgcagcttttgctgtaatggtaaaggatgttctgcctgccggtgtaaaaggtattgtaactattggattcatctgtgcattggttgcttcactggctgctttctttaattcatgtgccacactttttacagaagacttttacaaacccatgtttaagaacaaaagtgaagctacttatgttatggtaggacgtatcgctaccgtagttgtagttatcctcggcatggcatggattcctgtaatgatgagtctcggcagcctttacgactatctgcaaggtatacagtctctccttgcacctgcaatggtagccgtatttgcacttggtatattctccaagaaaatcactccgaaagccggtgaaactgccatgattgtcggtttcctaattggtatgatccgtttgctgactaatatcctcaccaacaccggaaaagatgtgatgactggctggttttgggaaaatacaacttggttttggcagacaaactggcttatttttgaaatatggttacttgtattccttttgttgttaatggttgttgtatcatgcttcactccggctccaaccgccaaacaagtggaagccatcacctttaccggcagttacaaggaacttatcagaaagagctggaacaaatgggatgttataacctctttaggtgtagttctgctttgcgcactattctatgcttatttctggtaaaccataaattaaaggctgtatgctttgaattatcttgaagaatacagcctgttaattttaaaccgacactaaaccatgaccacctattataacataaatcctaaattctatgtatctgtagactgtatcattttcggttttgacgaaggagaattaaaactgcttctactaaaacgaaattttgaaccagctatgggaaaatggtctttgatgggaggattcgtacaagaagacgaaagtgtagacgctgccgccaaacgggtattggcagaactgaccggattggaaaatgtatatatggaacaagtaggcacatttggcgacttagagcgcgatccaggagaacgagttatatcagtagcctattatgctttagtcaatgtaaatgaatatgacagggaactagtgcagcagcacaatgcccattggacaaaaatagacgaactgccacagctcattttcgatcatccgatcatgatttccaaagcacgtgaactaatgaagcacaaagcatcatacaatccaattggttttaacctgctgcccgaattgtttaccctgacacagttgcaaaatctatatgaagcaatctatggcgaaccgatggacaagcggaatttccgcaagcgggtagccgaaatggatttcattgaaaaaacagatttgatagacaaatcaggttcccgacgaggtgcttatctttataaatttaatgataaggcctacagaaaggatccgaaatttaaactttaaaataatgtgccgatgcaataatttgctaattgacaaattagcatattgccacattacccaattattcattatgttagaaaaattaaaagaaaaagtattccgtgccaatctggatttggtgaaacacggactagttatttttacatggggaaatgtttctgccattgatcgtgaaacaggcttggtagtaatcaaacccagtggtgtatcatacgatgatatgaaagctgaagacatggttgtagtaaatctggacggcaacgtggtagaaggttctcttcgtccgtcttcagatactcccacccatgtagttctatataaagcattccccgaaataggtggagtggtacatacccactccacctatgccaccgcctgggcacaagccggaatggatattcccaatatcggaacgactcatgccgattatttccatgacgccattccttgtaccgcagatatgacagaagaggaagtaaaaggtgcctacgaacaggaaacaggcaatgtgattgtgaaacgtttcaagaaactgaaccctgtacatactccgggagtactagtaaaaaatcatggtccttttgcatggggaaaagatgccaatgatgctgtgcataatgcagtagtcatggaacaggtagccaaaatggcaagtatcgcttttgccgccaaccctcatttaacgatgaattctttattaatagaaaagcatttcagccgcaaacacggtcccaatgcctattatggacagaaataagaaacaaagaaattaataacccttttaaaatataacattatggaaaaagcatttgatcagtatgaagtatggtttgtaacaggagcacagcttctgtacggaggtgacgcagttgtagcagtagacgctcactccaatgaaatggtaaacggattgaacgaatcagggaaacttcctgtaaaagtagtatataaaggaacagccaattcttctaaagaagtggaagcagtgttcaaagcagccaacaacgatgaaaaatgtatcggtgtcatcacttggatgcacactttctcccctgctaaaatgtggattcacggtctgcagcagttaaagaaaccactgttacatctacacactcaattcaataaggaaattccttgggataccatggatatggacttcatgaatctgaatcaatccgcccatggtgaccgcgaattcggacatatctgtacccgtatgcgcatccgccgcaaagtagtggtaggttactggaaagacgaagacacccagcacaagattgccgtttggatgcgcgtttgtgcaggttgggcagactctcaggatatgctgatcatccgtttcggcgatcagatgaataatgtagctgtaactgacggtgataaagtggaagcagaacaacgtatggggtaccacgtagattactgtccggcaagcgaactgatggaataccataaaaatatcaaggatacagatgtagaagcacttgtagcaacttactttaacgaatacgaccacgatgcttcattagaagataaatcaaccgaagcttatcagaaagtatggaatgctgcaaaagccgaattagctcttcgtgccatcctcaaagccaaaggcgctaaaggattcactactaattttgatgatttgggccaaacagacggcagctacttcgatcagattccgggactggcttcccagcgtctgatggctgaaggctacggattcggtgcggaaggtgactggaaatcagcagctctctaccgcactgtatgggtgatgaaccaaggactttcccaaggttgttctttcttggaagattacacattgaacttcgatggtgcaaacagtgctatcctgcaatcacatatgctggaagtttgtcctcttatcgccgcttccaaaccacgtctggaagtacacttcctaggtataggtattcgcaagagccagacagcccgtcttgtattcacttcaaaagtaggttcaggttgtaccgccactgtagtagacttgggtaaccgtttccgtctgatcgtgaacgacgtagaatgcatcgaaccgaaaccgttgcccaaattaccggttgcttccgccctgtggattccgatgcctaacttcgaagtaggtgcaggcgcatggatcctggcaggtggaacacatcattcttgcttctcttatgatctgacagcagaatattgggaagactatgctgaaattgcaggtatcgaaatgatccgtattgacaaagatactaccatcagcaacttcaagaaagagcttcgcatgaacgaagtctactatatgctgaacaaagcactttgctaattcatccatgaagaggggatgtgtcaaggctaataagattcttggcacatcccaccttattttatcatcattattgttgtaccttaaattataggttttaatatgaaatcagatgcaaaatcaaccatcgaagcaggaaaagctattctaggcatagaattcggatcaacgcgaatcaaagctgttttgattgaccaggaaaacaagcccattgcccaaggaagccatagctgggaaaatcaattggtagacggactgtggacttacagtgtggaagctatctggcatggcctgcaagactgctatgcagatctccgttccaacgtaaaaaagctatatgacacagaaatagaaaccttggcagcaatcggtgtcagtgccatgatgcatggttatatggcattcaataaagaagaagaaatccttgtacctttccgtacatggagaaacaccaataccggtccggcagcagccgctttatctgaattattcgtatataatattcctctgagatggagcatttctcatttataccaagctattttagacaatgaagagcacgtaagtgacattgactatctgaccacccttgcaggtttcattcattggcaaattacaggtcaaaaagttctgggcataggtgatgcatcaggaatgcttcccatagacccggctaccaagaattattctgccggaatgatagccaagttcgacaagttggtagctcctaaaggatacccctggaaactgacagatatcctgcccaaagtcttacccgccggcgagaatgcagggttccttacaccagaaggtgccaagaggctggacgtgtcgggccatttaaaagcaggtatacctgtctgtcctccggaaggagatgccggaactggcatggtagcaaccaacgctgtcaagcaacgtaccgggaatgtatcagcaggcacttcctcattttccatgattgtgttggaaaaagagttgtccaagccatacgaaatgattgacatggtcaccactcccgacggaagccttgtagctatggtacattgcaacaactgcacctccgacctcaatgcctggatcaatctgtttaaggaataccaagaactgctgggtatacctgtagatatgaatgaattatatggaaaactttacaatcatgcgctcgcaggtgatgcagattgcggtggtcttatttcatataattatatttcaggtgaacccgtgacaggacttgccgacggaaggccattgtttgtacgttctgcaaatgacaaattcagcctcgccaacttcatgcgtacccatttatacgcttcagtcggagttcttaagataggtaatgacattcttttcaatgaagagaaaatcaaagtagacagaatcacaggacacggcggattattcaagacgaaaggtgtaggccagagaatacttgcagcagctataaactcccctatttccgtaatggaaactgccggtgaaggtggcgcatggggaatcgccctgctaggttcttaccttgtcaacaatgaaaagaaacaatccctggcagattttctggaagacaaagtattcaccggtgatgccggtattgaaatatcgccaacagccgaagatgtagccggattcaacacatatatcgaaaactataaggcaggactgcctgttgaagaagcagcgacccaatttaagaagtgagtcaaacaggtttaaaaaagagcctctttacatgttgtggtttacacataaagagttatctttgcagatattaaataaaatagcaaggataaaccgactcactaatagcattcaaattataatattattttaatatgaacgaaaagaaacttatgaaccgtgcagcggacaacatccgtattctggctgcttcgatggtagagaaagctaattcaggacatccgggtggagctatgggtggcgctgattttgtgaatgtacttttctctgagtttttagtttacgatcctgaaaatccgcgttgggaaggacgtgaccgtttcttccttgatccaggccacatgtcaccgatgttatattccactttggcactgaccggcaagttcaccatggaagaactggcacagttccgtcaatggggaagtccgactccgggacaccctgaagtggacatcatgcgcggtattgaaaatacttccggtccgttaggacaaggacacacttttgcagtaggtgctgctatcgctgccaaatttctgaaagcccgtctgggtaatgtcatggaccagactatctatgcctatatatccgatggtggcattcaagaagaaatttctcagggtgcaggacgtttggcaggtcatttgggactggacaatctgatcatgttttatgattcaaacgacatccagctgtctaccgctaccgatgctgttaccagcgaagatgttgccaagaaatacgaagcatggcactggaaagtaattattatcaatggtaatgatcccgatgcaatccgcacagctctgacagaagcgaaagccgtaaccggtcagcccacattaattatcggtaagaccattatgggtaaaggtgcacgcaaagcggatgattccagttatgaacgtaactgtgccacccacggtgcccctttgggaggtgatgcttacatcaatacaatcaaaaacttaggtggcgatccaaccaatcctttccaaatcttccctgaagtaaaagagttgtatgccaaacgtgcagaagaactgaaaaaaattgttgcagaaaaatatgcagctaaagctgaatggactaaagctaatcccgaactggcagctaaattggaactgtggttctcaggcaaagctccgaaagtaaattggaatgctattgaacaaaaagccggagatgctacacgcagtgcttctgccaaagttctcggtgtactagctacagaagtagaaaacatgattgtttcttcggccgacctgtcaaactcagacaagaccgacggtttcttgaagaaaacacatgcattcactaaagatgacttcaccggcgcgtttctgcaagcaggtgtttccgaattaaccatggcttgctgctgcctaggtatggcacttcacggaggcgtgattgctgcatgtgctactttcttcgtattctcagactatatgaaacccgccgtacgtatggctgccttgatggaacttcccgtcaagttcatctggacacacgacgcattccgtgtaggtgaagacggtcctactcacgaaccggtagaacaagaagcacaaatccgcctgatggaaaaactgaaaaaccacaaagggcacaattctatgttggtactccgtccggcagatgcggaagagaccactgtaacgtggaaattggccatggaaaataccagcacccccaccgcactaatcttctcccgccagaatatcgcgaatctgcctgcaggaaacgactactcacaggctgcaaaaggcgcttatattgttgcaggttccgacgaaaatccggatataatcctagtcgcttcaggttccgaagtttccactttggaagcaggtgcagaacttctccgcaaggatggcataaaaatacgtatcgtatccgctccttctgagggattgttccgcagccaaagcaaggaataccaaaacagtgtcattcccacagaggctaaagtattcggtctgactgccggtcttcctgtaaaccttgaaggtttggtaggtgccaacggtaaagtattcggtctggaatcattcggattctccgctccttacaaagtattggatgaaaagctgggctttaccgcacagaacgtgtataaccaagtaaaagaaatgctggcatgaaaaaagtaggactggcatccgatcatgcaggatttgaactgaaagagtttgtaaaaacatggttgactgaaaaaggttatccatgcaaagatttcggtacatacagtacagaaagctgtgactatgcagattacgcccatccgcttgcactggctatagaagccggagaatgcggacctggagtagctatttgcggaagcggtgaagggatcagcatgacattgaacaaacatcagggtatccgtgcggcactatgctggattcccgagatagcccatttgtcacgtcaacacaatgatgccaatgttctggtaatgccaggacgattcatagaccatgaaatggctgaaaaaatattagatgaattctttaacagcggctttgaaggcggacgtcaccaaaaacgcattgaaaagatacctgtaaagtaaaattcacgcaataataataaaagtaaaaaaagagaggctttatagcttctctttttttttattcctatctttgcttagattaaaatataaaataagatatattactatgaagaaaattctttttttaatgctcttatgcctgccattcatcgctatggcacagacagatcccaaatatctggcgggagcaataactttggatgacggtaaagtttctttcaaaacagaaatacaggcaccgtctttaacgaaagaccagctatatgagacaatgctgaaatgggctacagaacgtttcaagcccgaaggcaagttcaatgcacgtgttctttacaccaatgaagatgaaggaaccattgcagcaggtggcgaagaatatctggtattctcatcctctgcattgtcattggacagaaccagaatttattatcagatgtttatcacctgcggaaacggaaaatgtgatatcgaaatgacccgtatccgctattggtatgatgaagctcgtgacggaggagaaaaatacagcgcagaggaatggattgtagacgatatggctttaaacaaatcgaaaaccaaactggctcccatctgcggcaaattcagaagagaaacaattgacttgaaagacacactgttcaaatccatccaagatacattgggcaacaaagtcttgaacaactcacaaattgcagttgctcctacttcgggtgtaacagccactccgatatcaaatacaaccacaatcattaccgccactccggtaactccccctgcccaaccggctatcatcggtggttctgagggtaataccgaaataaaagtagccaataatgtaactcctagcaaagaacaaagcatagatgaccaaatcaaggcatcttcacgtatgacaattactgccggaaacgatgaacaattcgaaattggtaaagaatgttggggaggtttcggtcagttattcggcaaagaagtagcattctgcataattgaccaatccaaatcaatgggcaatatgctaatggatcaaagcgacaattataaaatttcgttctacaagcaaggtagtagtgagccgtggttgatagtaaactgtaagaaactgatgaaacagacagttaccggtgaggaagcaaaaaaaatgaaccccagtaacaacggccagaaggcatataatatgtatgtaggtgaagtaataaaataatcttttcttctatatatttatgccgtgacagttaattctatacgataatacataaaatatttagggggggagataacctgacaactccccctaaaaaacatacaaacgatttaccatatacttccccccaaaaatatcatgacaaatacaattcaaacatatcccccctttaagaataaataacaccgttcctctatcaaccgtttcacttgaaaccatttctataataatcaaaccattagaagaaatcattcttccattttttccctatctttctctcctttttttaaatgtttttagcaagaaagtcgttttttctgctccaatcttccctttcataacaaataaagagtatctttgtaaacaacaatgagacaatcatgccttatgacggaagaattacaggacataaagacacttatcgaacagggtgatacggagagagctattcatgcgctaactaatttcatccgaaacgatgcgcacgtcaacgatgaaccctattacttactgggtaacgcctaccgcaaaatgggaaactggcaacaagctttgaacaattatttggaagccatcgagcgtaatccggaaagtcccgccgtttccgcccgtgacatgattatgaatattctgaatttctataacaaagacatgtataatcaataataactaacccatggcaaagattaaaggtgctattgtagtagacacagagcgttgcaaaggttgcaatctatgtgtagtggcatgtccgctacatgtaatcgcgctcaatgccaaacaagtgaataaaaaaggatacacattcgcccaccaggtattagaggatacctgcaatggttgcgcatcatgtgccacagtctgtccggacggatgcattactgtgtataaagtaaaacaacaataaatgtaacaaatatggcagaagaagtcgttttaatgaagggaaatgaagccatagcccacgccgccatccgtatcggagtagacggttactttggctatcccatcactccccaatcggaaatattggaaacgctggccgaagagaaaccttgggaaactaccggtatggtggtgttacaggcagaaagtgaagtcgcagcaatcaacatggtatatggcggtgcagcaagcggtaaaatggtaatgacctcatcctccagtcccggcgttagtttaaagcaggaaggcatctcgtacattgccggtgccgaactcccctgcctgattgtcaatgtcatgcgcggaggtcccggattaggaaccatccaacctagtcaggccgactatttccaaacagtgaaaggtggcggtcacggagactatcgtctcatagccctggcacctgcatcagtacaggaaatggcagatttcgtaggtatagcttttgatttggctttcaaataccgcaatcccgccattattctggcagatggcgttatcgggcagatgatggaaaaagtagtattacccgaacagcgcacacgcctgacagatgaagaagtcattgcccgttgtccgtgggccactaccggcagaacccaccaccgtacccccaacatcattacctcattagaactcgatcccgccgaaatggaaaagcgcaatattcatcttcagaaaaaatatgcagaaatagaagagaatgaagtacgcttcgaagaacttcactgcgaagattcagaatatttgatcgtagctttcggctcttgcgcccgcattgcccaaaaggcaatggaaatggctcgggaagaaggcatcaaagttggtttgctccgtcctattaccctatggccgttcccgtcgaaagctattgcagcacgcgccgcacaggtaaaaggtatcctcactgtagaattgaacgccggacaaatggtagaagatgtccgtctggctgtaaaatgtaaagtgcctgtagaacacttcggacgtctgggtggtattgtccccgatccggatgaagtaatcactgcactgaaagagaaactaataaaataagaccgtatgaatatcgatctgatcagaaatatattgaacatacttttcatggcactggcattagcagctgtcatcacttacttcgtggcaagtgacttcaaagtattcatctatgtctgtgcagcagctatttttctcaagctggtggaattctttatgcggttcatgttataaacaataggaggagaaactatgacaaaagaagaaatcataaaacccgaaaacctggtttataagaaaccgacactgatgaatgacaatccgatgcattattgccccggatgcagccacggtgtggttcacaagttaatagccgaagttattgaagaaatgggcatggaagataagacaatcggtgtgtcaccagtaggatgtgccgtatttgcatacaattatctagacatcgattggcaagaagccgcccacggacgcgcaccagccgtagctaccgccattaagcgtttatggcccggacgtctggtatttacctaccaaggagatggtgacttggcatgtatcggtactgccgaaactatccatgctttaaatcgtggtgaaaacattactatcatctttatcaacaatgccatttatggaatgaccggtgggcaaatggctcctaccactctggttggcatgaaaacagccacctgcccctatggtcgtgatgtagccattcacggctatccgctgaaaatgacagaaattgccgccactttggaaggcaccgcctacgttacccgccagtccgtacatacagttcccgccatccgcaaagccaaaaaggctatccgcaaggcatttgaaaattcaatgaatggcaaaggttctaatttggtggaaattgtatcgacttgtaattccggttggaaaatgactccgcaagcatccaatgactggatggtggaacacatgttccctttctatccgctgggtgatttgaaaaataaagaataaaaagacagaaaccatgaaacaggaaatcattatagcaggattcggcggtcagggtgtgctatccatgggtaagatacttgcctattccggactgatggaagacaaggaagtaacctggatgccggcatacggtcccgaacaacggggaggaaccgctaacgtaacggtgattgtcagtgatgaacgcatctcttcacccattctcagccaatatgacacagccatcatactgaaccaaccctcattggaaaagtttgaaggcaaaattaaaccaggtggtattctcatttatgacggatacggaatcatcgagcctccgacacgtagggacatacgaatctatcgtattgacgcaatggatgccgccaacgaaaaaggaatggcaaagaccttcaacatgattgtcttaggaggcttgctaaaactacgtcccgtagtatccattgaaagtgtaataaaagctttacgcaaaacattacccgaacgtcaccatcatctgataccgatgaatgaagaagccatccgaatcggaatggagattattaaacctcagtaagttaaaataactctaaacgaataataaaaggaagaactttccatagcggaaaagctcttccttttatttttatattgtatctttgccgccgttatgaaaagaatattctctattatttttttattattcctgtgcttccatacttccttgatggcacagcggacaatgaataccctgaacaaccagttcggttcctcagcaagcggactgaacagagatcaatatgaccgtaacggaaaccccatagacacgacagccgtagtagatgccagcacaatccccatcggactgtactcatggaaagtggacagtcgttttggcaatgtcacttatatccccgtagataccttgcagcacgctttccaaaactcaaatgacatgggcggctataccggacaatacaattacctgggaaatttgggctccccccgcctctcacgcatcttttttgaccgtcgggaccccagccaatactttttcaccgacccatacgatttttgcgtacaacgtccggaagatgtcatattcaccaatacactttctccattcacaaacctgacctattacaaaggaggaggcagccgtgacggagaagaacgtttcaaatcctattttgccatcaatgcaaacaaaaggctagggttcggattctacatagattacctgtatggccgggggctttatcaagatcagtccacagccttcttcaacggtggcctgttctccagctaccggggagataaatatgacatgcatttcatattcaacaacgataacttgaagatggcagaaaacggaggtatcacggacgaccggtatatcaccaacccgctggatatggcagaaggcaaaaaagaatattccgccaacgaaatcccaacccgactgagtcagatatggaatcacaacaccagctaccatgccttcctgacacatcgttacaacctagggttctataaagaaaaacaggacagtgtggatacggactctgtaaaaataacgcaggtatttgttcctgtcacaagcttcatacatacactacaagtagacttgaacaatcgcaaatacatctcatacgatgacgcacagaatcagaagtattttgaacataactatctggggaccgactctatagacaagacgaagcgtacatccatcaaaaacaccattggcattgctttacaagaaggattcaacaaatgggcaaaagccggacttaccgcctttttaagttatgaataccgaaacttcgccttgaccgacacaacaaacataccgggacaacgcattatcaacaactataaggaaagttcactctccattggcggcgaactatccaaaaaacaaggaaaactattacattacaatatcctaggagaattagccatagccggtgaagacgcaggacaattcagcgtagaaggcagaggggatctgaatctccgtttattcggagatacggtgagactggatgtaaatgcattcatcaagaaccagaaccccgtattctatttcaggcatttccagtccaaacattactggtgggacaacaacgatttatccaaaataatgagaacccgcctggaaggaaaactaagtctggacagatggggaacccagctgcgtgccggagtggaaaatataaagaattacacttatctggccaataccagcataccggtaaaagacagtgaaggaaatgtcaccggtttcaagaacaatgcagccgtaagacaacactccggcaacatacaaatattcactgcaatgttgcaacaaaaattaaaagtaggaatttttcatctcgacggtgaagtagcctatcaaaaatcaagtgagcaagacattctacccttaccggaattgtcggcttacggcaacttgtacatgaaattcggtctcgccaaaaaagtactccagatagaaatgggagcagatgtgcgttatttcagtaaatattacgcgccagactactcccccgtcatcggacaattctataaccagaatcctgatgacaaaatcgagataggagcttttccgatagtcaacgtctatgccaacctgcatttaaaacgtacccgcttctttattatgatgtatcatgtcaatgccggttcgggaaaatccaattacttcctggcgccacactacccaatcaatccgcgaatgataaagttcggcctttcatggaatttctttgattgacggtctatatgaaaaaatatctgaaatacgttctgatgggtatccttgcagcaaccctatcctccatcttcttcaaaaagaaaacggaggctgaaaccagtctgccccgcgattatgcagaaatagcggcatcgggaatcctgcgtgctgttaccgagtacaactcaatcagtttttatgccgacggcgacaccgtttccggtttccactacgaactgctccatgcttttgcacacagcaaaggactgaaaccggaaatcactcccgaaatgagcttttccaaaagactggaaggcgtacaaaaaggaacatacgatatattggccaacagcacggtagttaccacagaatacaaagactccctgttgtttacccgccccattatactgaacaaacaagtactggtacagcgtaaacccgaaaaagaaaacgatagtctgtacattcacagccagttggaactagcccgcaagacccttcatctagtcaaaaactcacctgccattctgcgcatacataatttaagtaacgaaataggtgataccatctatatcaaagaagtggagaaatacggacaagaacaattactggccatggtagcacatggtgacatagactatgccgtatgcgacgagagcattgccaaagcttccatcaatgattttccacaattggatatagaaacagccatcagcttctcacaattctattcatggggagtaagcaaacattctccaatattgcttgacagcctgaattcctggttaaatgattacgtcaagactcctgcattcaaactgttgcgcaagaaatattacaataactgatttttatccagctgaaattgcaaaatagtcctatctttgcaatataaattgttattattttaagcggaatgacaaaaaagttattaccatggttaaattagacaaagtaaaatggggcttcatcggttgcggagaagtgaccgagaagaaaagcggaccagcctttgccctgatcgaaggttcagaggtagtggctgtaatgagccgtgacaaagaaaaagctcaatcatacgccaaaagacacaacattccccgctggtactccgatccgcagcagttaataggagatgaagatgtcaatgctatttatatagccactcccccttcctctcatgccactttcgccattatggctatgaaggcaggaaagcccgtgtatattgaaaaaccaatggcagccagctatgaggactgcgcacgcatcaaccgcatatcacaagaaactggtatcccttgtttcgtcgcttactacagacgttatcttccctatttccaaaaagtacgccaaatggtagaggatggtgaaataggtaatgtcatcaatatacagatacgtttcgcccagcctccccgtgatttggattacaacagcaccaacctgccctggcgtgtacaacctgatattgccggcggcggttatttctatgatctggctcctcaccagctggatttattacaagatatgttcggctgtattctcgaagcccaaggatacaagagcaaccgtggcgggttatatccggcagaagatacgataagtgcctgcttcaaatttgattccggtctgccgggatcaggatcatggtgttttgtcgcccatgaatcggccaaggaagaccgtatagaaatcatcggagacaaggggatgatctgtttttccgttttcacttacgatcccatcgccctgcatactgaaagaggacgcgaggaatttcttcccgaaaatccccctcatgtacaacttccgctcataaaagccgtagtagaacacctgcagggaaaagctgtctgtacctgcgacggcatcagtgcgacacccaccaactgggtaatggaccgtatacttaataaactctgatttccgcctatggacatccgtaaattatgcctgctctgtctgtcttttctttctgcctttaatgtatatgcacaagcggaaaagaaagactcgacagtacaggacaacaagggtgttctcattacattgactgacggaatagcaacgactgtccgccataccggaagaaaaataaggaaagtaggaaaagaattcaatgcgattgacactacctatatctcgcccaacctttacaatctggctttcatgctggaatccagcagttggtacgaatactatcggttaggtagtaaaggaaacaacggcgaacaaagtttgggattctcccccaatgccagtttcaagctgggagtctatttcggatggcgctggatatttctaggatattctttcgatgtaaaagatattttcggcggacataaaaacaaggcaaagaaaaccgaaatggcactgaatctttatagttccaaatttggtgtggatttatattacagaaagacaggaagcgatttcaagatacgttcttccagcggttttgatctgaatactcccattaaaaatttgaatttcaacggattgcaaagtaaaatcaaaggactgaacgcctattggattttcaattataaaaaattctcttatccggcagcctatagccagtccaccaaccagcgtaaaagcgcgggttccctgatggcgggcttttcttattcccagcacaacatatcttttgattacgaaaagcttcccggtgaagtgagagtccaactacatgatgctttacttttcaagaaagtgaaatattctgattacagcatcaacgtgggttatggctataactgggtatttgcaaaaaactgggtttccaatctttcactcttaccggccattgcctataaaaaatcaaaaatagacgatacacctaatactgacaatcattggataaaggatatcaattttgacctgataacacgtgctgccgtggtctataacaccaacaaatattttataggagcttcgttggtgatgcatacatacgactatcgaaaaaaggacttctccctcactaatactttcggaactgtccgtatatatgcaggattcaacttttggaaaaagaaagagttccgtgataaataggaggaggatgacaaaaacggaaagtgaaaaaagagaaatgaagaatccaatcacatccatttgttctcacaagatccctcaccatgactcaaaatgacagaatccgtgattacacaacagaatcctgacataccttcattcattaaagtctatctatttcatctatagacaagcctgtagcttgaacaataacagcaataggaatattcaaagatttcaagttacgggctgtagctattttttcttcttggcgacctaccatgataccttcctcacgtccttctacacgaccttcctccaatccttctaatttagcggtactcaatacatcattttgtatcatcaatgcatccagatgccgatcataagccagtttatcagccttattcatattataataaataagtttctgtctcgcctcctccaatccgggagtcgttgtatccggacggatagttccagtcttaagatattctatccattcttccaaaggagtaaccgccactttattaaactcattcacacgaataagaaaatattcaggaaatatttcggcaggcaatttgcggataatagccccttgttctttagtggttactttcaaacagtcaccagtatggacaccgaggaatgtattctgaccatggtagaggtaatcatttccttggccaatatcaaaataaagaatactgatagaatacactttcttgacatttgcataaattccacctaaatctatatgttcggttattgcttttgccactccataaagtattcgttcaagataatataactcccgcgtattctgcacttccactagtattatttcatccttgctattacgggctttaatatctacccggttgaacttatcatcctcccgttgctggttaccttcgctctcaaggatttccatgatttgaatcttctcacccaaaagtacggtaagaaaaccttctaggacaccaaaattggctttgttgcgtaaaagacgcttgattgcccaatcaaaccgtatgtatttatctttctgttccataaaaacctctttttacaaagataacccttttgtttgaaaaccaggatgaaacattagcaaaaaatataccggaaagcaataaagcattcccggtatatcacaagttaattatattagactcacaattaattcttagaaacgagcaccgacagtcaaaagcaactgatgccgttcattgtccactttagttgccggaagatctatatcatcaaaagcataaaagtttgatttatacatatcatatttatatgccaaatccgcataaattacactgccacggtatccaagaccaaacgtaaatgtattcttagactccgtattattaaaatcagtacgcgtgctatataaagacaaggcactataagcatctttagaaaaagcagccgaagagtaattatatcctgcacgaatgctaaactcaggtataatcctcgtttccattccgatacggaaagtatggacacctttcaaataattctcaacgctgggctgatctcccaattcataaccatccacatccttgagcttactggaagaataatcctgatattcatattccgcacctactgccactgcacccgcaaaagtagtacctgcgctgatattaaatttccacggagtggtaagattataatcataggtcaaataatcatattccggagttaccaaaaaatcactcaatgtctggttatagggtgcctcacaagctaaaatattagaagataaagcggcattatagctttctcttaaatcataccatgtaggcgtgtgcacagcaaatcccaaacggaaaggggaactttctataggccgtataataacacccaattttaaatccataccagtcccttccagcctataataattatccaatgtataccccccattatccgcaccgttatcatcattcaaattttccgtataagaagtataacgatcataattcacatcatagacccccagggtagctcctaaatagaccctatcttcaatattgaatgaaacattaaaatcatattgactgatacctcctgtttccttactaaagaagttattgttaaaaccattccacccccatggagcatgaatattcttttcagaatcattaacccagtcaaccacaccggttctcacccccattactcctaaaacaggtaactgattccaatatttggtataaggattcttcacatccagtatgtcattaaactcgctttccgtcaatccatatcgttccatctcctgagccagctggaagctttgtgacaaattatccaacgcccctcccatagagaaaaggcgattgaagtttttacttttatggtaattgaatccgaaattcacaaaacgcaaagaagtattattgcctatcttattgctataaacaaatccaatctggtcaaatgaagcgcgcgttttgttttcattcattgacacaccactaaagttactctttgtcgaagtattattaaaaccaaaagaaatagacacgtcattactacgaaaaatgccgatacccgcagggttggagcttatgacagatatatcaccgcccaaagctcccatggcaccacccataccaacaaatcgtgctgttccattcaagtcattccccagcaacttttccgcatcataagcattttgtgcgcttgccgttgtcattgccaacaacgcacaagcggttactattactttatttttcatacatcaattctattaaattcaactgtctagtttaatctaccacttatctggtacgcgatctgccgccaccacttgaacgggaaacaccgccaccggaactgcgagaagcaccaccgccactagaaaaactactacgggaagaagaagttccactactacggtaagagttagacgaactattacgagaaggactactgctacgagagtatgaactgctacgagaattcgaaacgccactattgttacgataagcgccacgacttgcagcccctgttctctgataagcagatcctgctgcatttcccacactgctccgagtactgcttggtctggtataggaagaaccccttccttctgtcggacgtgaatacgaattacccggacgaactcctgctgcctgacttggtgaaagagtttctccggtacgggttctgatagcacttctattaggacgaaccgaatttacactgttagatcccgaaaccactcttcctgatgaagaaccgttacgtgttgcggtacgataactattagcactattacggacattttgtctggaatttcctacgtatgaattacgactattcctatcataactattcacgtaattattccggcttgggcgtgaagaactatagctattggtatatcttccggcatgtatccccgggttacgtctgcttgagccataccatccatgactacctccccagtagccaccaccccaaccgtgaccgaagtaatgcggataataatggtgatggtgataatggtagccccaatagccaccccagtagccgccaccccaataaccgggatagtaccaactattgtagtaccatggcgaactccatccccaactgaatccccaactggcgccatatggataattccaacgccaatcccaccataagcggttcgtgtaagtgggaaagacgtatgcatacaatccgtcatcatatacattccaatcccatgaaggcaaaccgtaaactacatcccaatagagcggactgcttaccggaatggcgtaacggggattacggaaacggacgatacgcatcgcgtattcataatcgtcttgagaaccctcaaaaccattaacccattctcctctctcattcaaaggtttctcctcaatatacaaggtatcattctccatcgagaaattattatcacgtgaagtataacgacgattatactcatccacatcgcgaacctttcctttcacatccttcaccaccactgtagaaccgggggctgcgtaaacagtagtcgtgttctgcttctgcggaaccaccactttcacctcttgcttaacctcctctttcttttcagcttttttcttagggatgaaataaaggtcgtcatcaacgctttgtgacattgcccaataaggcaagcacaccatcataagcgaagttaatacaatctttttcatactcgtacctgttttatttgttattctatctactttttctagtgcaaagatagccagaggtttcagttcataacaaagaaaatccctattagttggtagggatttccctattttagtaacggacttcaactattttatctatttctgcacacacggaaaacagaagaacgtccgttcacatacgttgatggtaaacaaatctggtggtaaaacaactttttataataagttgcacccacttataccctcatgccctcactaaaagccataacctactcattattaaaccactacccacagtgagggcatgttaaaaagtgagagcattgccctcatgccctcactcctaatttcttgcttctctcactttaaatcattcattcacaacataatacccatttatcggcttataaaccggttgtttgggaagtcccacatttttcagctttccttcctcgcacaagcggcgtaaatggcggctggccgtgctttgtgtcataccgcaaagaagctggaaacttttccgctgcacaaaatcacaggttgtgaagtactccgtcagcaatgcgtcaatctcctcatcggtcagtttactggaatgaaacgagaaccgggtacgctgcacctttacctttcccacctcatccatcaatagttgatcgggacggtaaacaatccccttgagcctcaccttcgtattcttacgtttcgtcttttccgttaccggcccggtactcaccaggttgggacggaagaaaccgatgccgtccagatgcacctgtttgccttccgccaactcctcgcccatggcacgtgacagcgcatcgagcacggctaccacatccgtttcagtcaacgtacaatgtttctgaatacgggcacggagctgggccgtgctcacctttccgttcagccggagacgcgggtgcaacgtattctcttccccttgttgctcaggggatttgggattctcgtaccaatcaaatagtattgccatactgttcttcttttattaatgaactttcaatatctgttaatcacggacgtgattaagtttaactacctttgtggttaactttaatcacccttgtgactagacttaatcacaagggtggctaactaattataaacatacaaaaataagaaaagaaaaggtagaaaacaaataaggaacagggaaatacgcactgagactaagaataaaaacacaggaaagaaaggaaaaagaaaaaggcggcatttaatccggaaagcacttgcagaatccggaaagaaaccttacctttactaaaaatatgcacacatagacactcgccaaacgcggtcttctccacacgacagaacatcatctttttccatgggaggtacataaagccaaaaaacatttaaacgaaagacaaatatgaaaattacactcatcaggaaagatgaagaacaggggacagaagccttgtcactatgcgattcgaacacattcttcgagaaaataaagacagagaacaaagcaggacacatatcggaactgcgtgaaatactgccccggctgacaggatcgtccgcccactacgcccatatcgacaaactgccgcgtgtctatcctgctgtagaatatacccgtaagcaaaatggcgagaaacgcatgaaacattacaacggactagtgcagctggaagtgaaccggctggccgacctgtatgaggtggaatatgtgaaacgccaagtagcacaactgccacagacctttgccgctttctgcggttcaagcggacggagcgtaaagatatgggtacgcttcgcacgccccgacggcactctgcccaccatacaggaggctctcctgtttcatgctcacgcctatcggctggcggtgacctgctaccagcccatgcttcctttcggcatcacactgaaggaaccggacctgatgcaaagctgccgcatgaccgtggatgaacaaccttactataacccttcgtccgtccccttctgcatagagcaaccgcttgccctgcccgatgaagagtctttccgccaacgcaaacaaaacagcgaaaccgcactggaacgaatgacgcccggatgtgaaagtttacagactttgacactgatgtaccaatcggcacgaaaaagagcattggccgaaatggaaaactggaaacgtgatgacggactggaacccttgctgccccatctggtagaacaatgcttcaaagcaggcatccccgaagaagaagccgtgcggcgtacactaatgcactatttccacgaaacgaacacggaagccatccgcatggctttcggcaacggatatcgggagatgaaaggctttggcgagaaaggtggcctcaacaaagagcaggaagccaccttccggctggaggagtttttgaaacgacggtacgaattccgtttcaacaccgtactggacgaggtggaataccgccagcgggactctgttcatttctatttcaaacccttggaaaaacgtacccgaaacagcatcgccctttacgccttgaaagagggactgcaagtgtgggaccgcgatatcgaccgctttctcacttccgatttcgtccctctttacaatcccgtagaagaatacttgtgtgaccttccccgatgggacggtactgaccgcatccgcgcattggcccggctcgttccctgtggcaatccgcattgggaagaactcttttaccgttggtttctgggcatggtggcgcattggagggggatggaccgtcagcatggcaacagtacttcgcctttgctggtgggttcacaaggattccggaaatccacttactgccgcatcctgctaccgcccgaactgcgtttcggctatgccgacagcctggacttcagcagcaaacaggaagcggagcgtgccttgggacgatttttccttatcaacctggacgaattcgaccagattacgatgaaccagcaaggttttctgaaacatctgttacaaaaaccggtggccaacctgcgaaagccctatggaaccagcgtacgcgaattacgccgctatgcctcattcatcggcaccagcaatcagaaggatttgctcaccgaccccacgggaagccgtcgctttatctgtatcgaggtgaccgctcccattgatacccatgtcaccatagactaccgccagctctatgcacaagccatgacattgctttatcagcaggaacgttactggctgaatgatgaagatgaggctgttttgcggcaaagcaacagcgaatttgagcaaatttcgcctttggagcatttattccattgtaacttttcttctgcaaccactgatgaagagggagaatggctgactgccatggagattttcaattatctccaagaaaacacacgtgataagctatccgtcaataaaataaattggttcggacgtattctacataaactgaatgtacccaaaagagccagtatcagaggtactttataccacgtggtcaagttggaataatttatttttcaagaaatgagtatgaggtcaatgccctcatactcatttatgttaccatcatcaatagcacactcattataagcgaattataccactaatgagagtatgagagcattattgagagtaacttcctgttgatatcctaccggaatgaagaaaataaatagatgctgaacgggtataaagagagaagcaattaataccgattctgctcttattctcattttttctccctatctttgccactaccctttttaagagtatataaacctaaaataaacagccacatgaaaccagtgaaattattttatcaggaaagatgcccgttctgcaaaaaagcactgcgctatattgaagaactaaaagaagaacaccctgaattccaacctatagaaatagaaatgatagaagaaaaccaacatcctgatatagccgaccaatacgactattattacgttcccacgttttatgtggacggtgtgaaagtacatgaagcgggtattttcaaaaatgagatggaggcactgctccgtaaagtgatagaataaacgaaagcgtatgaaatatttagaagtaacctttacaacacatccctgtaatgaaacagtgaatgatgtagtatctgcactggccggagaaataggatttgaaagttttgtagaatgtgaagcaggagtacaggcttatatccagcagactttgttcgatgaggaagcattaaaagaaatgattgcgagcttccccctgcccgacactactgtgacatataccattaaagaagccgaagacaagaactggaacgaggaatgggagaagaacttctttcaacccatcgtcatcggtgaccgttgctgcattcacagcacgttccataaagacaccccgaagactgagtatgaaattctgattaacccgcaaatggctttcggcacagggcaccatgaaacgaccagctctataatcagcgagatgttagaagctgatctgaaaggaaaatcagtcttggatatgggatgcggcacttctattcttgccatccttgcctccatgcgcggagccaatcctgtgacagccatcgacattgacgactggtgcgtcaataattcaaaagacaacattgcactgaaccatatccataacattacagtggaactgggggatgccaacttgttgaaaggtcgcaagccgtttgatgtaattattgccaatatcaaccggaatattcttctggcagacctgcctcattatgccgcctgtatgcatccgggttcagaaatatttatgagtggattttatatgcaggatattccttttatccgcgaaaaagcggaaagtctgggaatggagttcgtacaccatcgggaaaagaacaactgggcagctgtgaagttcatcatgaaataataccatttttaagtatgaaaaggacttgataaagacaggattaccaccaatcacacaggatttacattgatttattcgaggacaaaagaacggattttctctcttttgtccttttgttcttcttacctgaaaattagaaccggaatcaagtggtgacaaacgcacgtaggacgctgcattttatccaaagtgacaacacgatcatatcggtatacaatatttatacaatctcctttccgaaaggagtaagtgccaagcccgccagcttgaaatgttgcagtccgaatggaataccgataacagtgatgcaaagcaacaccccgaatgccaaatgagagaggctgatccagattccacctacaagtatccagatgatattcatcaacacactgagacatccgccatcaccgggacaactgcgtatttcccgcccaaaagggcaaagagccagcatagacaacttcaaagtttggaaaccgaaaggaatgccgacgatagtgatcatcagcaacaggctggaaacaatatattccacgcagatcagaaatccgccgcaaatcagccaaataatattgagcagtaagttcataaagcaaatataaagaaagttttcgaaaccgcaggcacagtatcctttatttctttatagtcattagttgcaattcctccaacgaaccgttgaaaatattcaagtccaccttctcacgaatgcccggcaacgtacccacatccgtatgctgccagaatttccattctcccctgtattccaccgagtctacataataatgggctatccagtaaggataagaattgaagaccgaatcattcagataacgagttttaaacttataagaagtataaagaataggcttcactttgtagtgctgttctattttgtcaagccacagtttaaggtcacgacggagctgattttcgtccttgcctctcttctcgatatcgagtacgggaggaaggtcacctgaatccagctttacggaattaataaagaaatcggcctgacggatgggatctgttttcggattgtaaaaatgataagccccacggataaacccatgtgttttcgccgaatcaaaattggtgatgaaagccttgtccccataatctcctccttccgaagctttcataaagacaaaatgaataggaaatttcccctgtcgggtctgagtcagcattttccagtctatgtttccttgataatgggaaacatcaatgccatgcacctgaaaacccgagggcatacatacaccgtatgctttaaagccatagcaaggcttccagcgataagagtaaggacggataaagaaataaaagaaagcggcaagaaataaaaaagcaataagccccgcaatgacataccgaagccatgacggcatctgtctttgtggtttctttttcgccttccgctgtgtagcccgacggacaggtttcgcggctgccttctttttaacgggagcaggacgtgtgcttttcgctcttaccattttatcctatttagctgtttttacctttacctattcccacatactatgtaataaaacccatcgggagaatggttttacaatcagccccgatgggtttcctttatgctttatagaaataagaaagaattattttccttgttccaactgcaatgtcttggttgcctggtcacaaacttctgtaggaccgaagtactggataggacccggatatacatagtctgtttcaatagcccaacgttcacgctgtgcggcaaacgccttgaaaggagcaccatccaattttaccaacgctttctggataaccggtttcatttcaccgtgacgacgttccatgttcatcatcattgtgataggcacaccacctgcaatccattcttcggcaggagcagtagtgttacgtacagaagacatatagccggtcttaccgttgacaatcaacatagaagcggtgtaacccaacgagtagcaatagtcagcatcgaagtttgacggagcagcgcaacgtccttcgtaaccgaagaagtgatgctgagcggcaaatttacctacatacttgccttcttccttccactgagccaatttaacggctaccatatcagacaacagcttttctgtttcaatcaatgatacctgtacgtttccgtgcggatcacggtccaaagtaagctgacgtgcaacgccttcgggcagagaagcatagatttccgagttttccttagaaagcttggagatgatatattcacgttggtgagatttcttgatcaatgcgaactctgatgcgttagcagccaggaagtcattcaattcagcgatcaatctcttcattgcgggaatgaattcgatcaaaccttcaggtatcaacactgtaccgaagttattaccttgtgcagcgcggttagccactacctgagcaatgtaagtaaccacatcatccaatgacatgttcttctcttctacttcttctgaaacgatacatacgttaggttgaacctgcaaagcacattccaaagcgatatgagaagccgaacgtcccatcagcttgataaagtgccagtatttgcgggcagagttacagtcacgctgaatgtttccgattacttcagagtaagttttacaagccgtatcaaaaccgaaagaagtttcaatcatctcgttcttcaagtcaccgtcgatagtcttcggacaaccgattacctgaacaccgcagttcttcgcagcatagtattctgccaatacacaagcgttcgtgtttgagtcgtcaccaccgatgattaccaatgccttgatgcctaattccttgatgatttccagacctttatcaaattgttcttccttttccagtttggtacgtcccgaaccgatgatatcgaaaccaccggtattacggtattcgtcgataatatcggaagtcagttccatataattatggtctaccaaaccaccggggcccagaatgaaaccatacagtttgctgtctttgttcaatgacttgacaccgtcgaacaaaccggaaataacattgtgtccgccgggagcctgtccaccagacaaaatgacacctacattgatagcaggcatattgacagcttcgccttcaacgaactgaatcaacggcataccgtaagtgttagggaacaaagccttgatggcttcctggtcagcaacagactgtgtaggttcgccttcctttacttttacagcgcctttcaacgctttaggaagtttgggctgataagcagctctggcaatttgtaatgcacttttagtcatattctattattctatttaaaggtgtataatttcatttagtattctcgtgcaaatttcgctcttttttcgcaaatatgaaaacgtatacaaataaaaatgctacctttaccgcgaatttagaattatgtattaacttaaaacattacatttatggcaagtagaagaaatttaaagaagaaaataaccaatatagcaagtgatttgtttttagtcagtttgatggaaggtgttaaccgtgaagtggtttgcaactctgtacacaatgtgatcaaactgattacacgcatcagccacaccgagccgggtaacgtaaaaggattctacaagaaattgaacgaagatctgaacaaagaaatcaaagtggttgcagacgaactggctaaagctacaaaagcataagatttaaggaatgaaaaaagctatttgtagttttatctactacaaactgttgggatggaagaccaaggtgtctgctcccgattatgataaatatattatctgtgccgccccacataccaccaattgggacttattcataggcaaactgtttatgggagctataggccgcgaaactggttttatgatgaaaaaggactggttcttctggcctctaggccctattttccgctggatgggagggattcccgtagaccgtagccgcaagacttcattggtggaccagatgatcaagattgccaaatcgagtcaaaaattccatctggctatcactccggaagggacacgcaaagccaatcccaactggaaaaaaggattctattatattgcacaaggggccggtctgcctattattctggtagccatcgattacgcaaaaaagtgcattacagccgaaaaggtgatacatcccagcggtgatttggacaaggatatgcgtgagatcaagttgtattacaagaatttcaaaggcaaatatcctgaaaatttcagcatcgggaaagtagaataatccccgtctgttataattctttttaaataagggaacactgattatacggattaaaacaaaatccgcataatcagtgtcattgtatctattctcttaccacgctctcatccccatcctcaaaattattcttctctatcttcacattccgggtgtgaagcaagcggaaacgagtcttattatgatggaaagccggataatctgtattctggcggatcacattgtttttaaagaccaatccgtcaatggattttgcaaaaagaacggggcggtcaaaggtttcaaaatagttgtcttcaatcaccactcctttttctccttttccaccatggaaatatttcttctgatgctccaaatcgggaatctccggataaatagagataacagcttccgtaaattggaacatattagtcaatgcattgataaaacgattgttacgaatcagcacgttccggcaagctcccgtttcaaaccaaccattgcaatcaccacaaagcagaatagccgtccccgaagtatggtcaaacaggttacgctctactaccgttttcaaaggagtgctgaataaagtaccccgtgcgcgattattacgaatgacattatccgcaaaatacacttccggacaccaagacaggttttcaataccaaagccttctttatccgtaatctccgcatccaaaggttccgtaaaaataatgcggtattctttcgcacctttcaccgtatctttatcgttaggcaggatttctttcacccggttttttccaccggccagttccatggtgacggaacgtacaaattgcacctcatctccgttcactccccactcgaacccgtatgcttgcggatgcatgtattgagcaatcactgtatggtcatcaaggcgttgcttgattttcaaataagtgccgtgtacattaatcgcatcatccatcattccttcatacagcccgttgcgggaatcaatcttgcctctgcaactggagaaatgagtagcatccgcctgcgtggtaaaataacgaggatccttatcgccacgaagacaaacgctgaattcatccaacgtgatattttcacataactgagccaataatcccatgccttctgcataatgcactttcacattctgcaaacaagtatttttgtcaccggacaaaaatatacccggagcaggacgataataagtacgaagtgcaaccactgtccccggtatcaaccgggcgtctttccactgaggagcatggtagacacgtggagaaacttctttcaccccttccataggacaccataagtcactagtgcggtataccagacgctttgtcttttcttcaaaagcaatccctccctggggagcactggaccagccttcgccgtatgattcaaagaagcctttctcattgatgcgacatttcacccatgcggcaggttcaaaagtaattccttcctctccacttttcaacaccttgacctgagtaatgtggggagtttcaaaatctatgctgaaattacgtaaagtacaatcctctgaacgaagcagagaaagtggaagcatacggccatgaaagataaaatcggcaccttgtccgtccacggtcagccccttccaatcctccagaggaaaacctaccgttttcggattatcctggtcatggttggaaatataatactcacggacagccgccccttcagggtggaaatcgtaacgtccggattcaaaaagcagggtgaccttatcgccggaagcgacttgagtcttgatgtcttgtaacgccttctgcaatttagctgaaagattctcgtgtgtgtccggtaccagaccataatttcgcatttcgactactttacttccggcaaaagcggaaacagcgagccatacgaagcagaaattaaagataattcgtttcatttaggttcattataggttagttagaatgacaaaactaacaaaaattcctaacttcgcaaccataaataaagaagaaaacaacatgaaaaagatatttttgtccttcctgctggtgatggtaggaatatcgcacactttggcacaagggttagacgctaatgtggaacaacgtctaaaagatttcttcacccaatatgaaacatcttacgccaacataggcaagtgcaagttagaccgttatgaagtcaatcataaccaaaagaaactggacgtatatgccagttccagcttcggctaccaaccgttcacacccgaaaacacggaagccatctaccggttactcaaacaaagcttacccggccctgtaaattattacgatataaccatttatgccgatggaaaatccatcgaagacctggttcccaactatctgagaaagaaacaggacaaaagccgcttatggcaacggacagattataaaggtaatccatgggtaaaaaataattcccgcccctttactgccagcaaaggattagaaggcagacacatcgccctttggcaaagccacggaaaatattataagaatgacaaaggatgttgggaatggcaacgtccacgcttgttctgtaccacagaggatttgttcacccaatcattcgtcataccttatattatacccatgctggaaaatgcaggagccatagtgtatactccccgtgaacgtgactggcagcgcaatgaagtgattgtggataatgacattcatccccaaggttgcatctatcaggagataaaaagccggaaaggtaaatggaaaaccgcccccaccccggcattcgctcaaaaacggttgatttacagggacggacaaaatccttttgaagaaggtacagcccgctttgcctccaccgagaaaaaaccggaaaaagcctttgcacaatggattccccgtattcccgaaacaggaaaata
